United States Patent 10,233,495 (METHODS AND COMPOSITIONS FOR SCREENING AND TREATING DEVELOPMENTAL DISORDERS) - sequence listing, part 144

SEQ ID NO: 736 - DNA, 688305 bp, Homo sapiens
  misc_feature (12664)..(12763): n is a, c, g, or t
  misc_feature (31773)..(32778): n is a, c, g, or t
  misc_feature (56221)..(56320): n is a, c, g, or t
  misc_feature (86122)..(136121): n is a, c, g, or t
  misc_feature (145293)..(145419): n is a, c, g, or t
  misc_feature (146936)..(147035): n is a, c, g, or t
  misc_feature (148716)..(148815): n is a, c, g, or t
  misc_feature (150516)..(150615): n is a, c, g, or t
  misc_feature (251273)..(251274): n is a, c, g, or t
  misc_feature (251288)..(251912): n is a, c, g, or t
  misc_feature (260826)..(260925): n is a, c, g, or t
  misc_feature (274962)..(275061): n is a, c, g, or t
  misc_feature (275597)..(275597): n is a, c, g, or t
  misc_feature (281352)..(281451): n is a, c, g, or t
  misc_feature (298664)..(298763): n is a, c, g, or t
  misc_feature (304942)..(354941): n is a, c, g, or t
  misc_feature (355893)..(355992): n is a, c, g, or t
  misc_feature (356976)..(357075): n is a, c, g, or t
  misc_feature (358228)..(358327): n is a, c, g, or t
  misc_feature (359748)..(359847): n is a, c, g, or t
  misc_feature (360794)..(360893): n is a, c, g, or t
  misc_feature (362393)..(362492): n is a, c, g, or t
  misc_feature (363898)..(363997): n is a, c, g, or t
  misc_feature (365776)..(365875): n is a, c, g, or t
  misc_feature (367989)..(368088): n is a, c, g, or t
  misc_feature (369701)..(369800): n is a, c, g, or t
  misc_feature (372033)..(372132): n is a, c, g, or t
  misc_feature (376157)..(376256): n is a, c, g, or t
  misc_feature (383108)..(383207): n is a, c, g, or t
  misc_feature (391127)..(391226): n is a, c, g, or t
  misc_feature (404351)..(404450): n is a, c, g, or t
  misc_feature (417010)..(417109): n is a, c, g, or t
  misc_feature (429522)..(429621): n is a, c, g, or t
  misc_feature (442967)..(443066): n is a, c, g, or t
  misc_feature (474456)..(524455): n is a, c, g, or t
  misc_feature (524516)..(524615): n is a, c, g, or t
  misc_feature (525965)..(526064): n is a, c, g, or t
  misc_feature (527800)..(527899): n is a, c, g, or t
  misc_feature (529611)..(529611): n is a, c, g, or t
  misc_feature (529960)..(530059): n is a, c, g, or t
  misc_feature (533550)..(533649): n is a, c, g, or t
  misc_feature (535102)..(535201): n is a, c, g, or t
  misc_feature (538525)..(538525): n is a, c, g, or t
  misc_feature (538538)..(538538): n is a, c, g, or t
  misc_feature (538618)..(538717): n is a, c, g, or t
  misc_feature (539114)..(539213): n is a, c, g, or t
  misc_feature (543095)..(543194): n is a, c, g, or t
  misc_feature (545114)..(545213): n is a, c, g, or t
  misc_feature (576465)..(576564): n is a, c, g, or t
  misc_feature (601651)..(601750): n is a, c, g, or t
  misc_feature (626564)..(626663): n is a, c, g, or t
  misc_feature (636320)..(686319): n is a, c, g, or t
aggaaaaactttctttcaaaaaaaaaaaagttgtaaattaaaaacccttcccattccgcttttattgatttcccccaaaaaactctgttgtatgagctgaaccagaggcaaacactgtttgccagaagactcacagatccccgtattaataaggcctttatccaatggagtcctccttctatgaaatgttgaggcatttgcttcctgttcataaatttctttttccttccgtgcttctttttttgtatcctgtaattgataaacagaaattgtttacaagtgatctcattaccaggtgtgaaggcacacaggctggctgagccctgaccccagtgccaagctatcccagcctctgtggctgccacacccatccacccacaggcccccacctgccctgttggaaaccccaactcatttgtgcagtttcaaacagtgtcttctttttacagatccaaggtctaggctgcctctgctgatgctctccagcctccttctgtgaagtccctaaaatccttaaccctgctaatggctcacacaaaacccaatgtgatcggctccacacacgcagcatccagctgctctgtaaggacaagaaggagctagaattctcacacacaaaagtcctggttcaaatgcaaatggcaaagccactttgggaaactatgaacacacactaaccccaggacctaacaaattccactccaagtgtttatccaaagggagaacatatgttcactgaagtacttgttcacagcacaattgtggcagctctacacggccaaaaaccagaaagcctgggcgcggtggctcacgcttgtaatcccaacactttgggaggccaaggtggggggatcactggagcccaggagttgaagaccagccttgcaacacagtgaaaccttgtctctacaaaaaaatcaaaaaactagccggacatggtgacatgtatgtggtccctgcaacacaggaggctgaggtgggaggatcatttgagcctaggagtacaaggctgcagtgagccaacatcaggtcactgtatacagcctgggtgacagagcaagaccctgtctcaaaaaaaaaaaaaaaaaaaaaaaaagaaaacaaaaaccaaaaacaattacatgtccttcaataggaaaatgaactaacaaacagtactacacctataaaatggaaaacttcccaataataaaaacgaagtcgcaatacacacaacagtgagcgaatctgaaaatcattctccaaggcaaagcaggaaagagtgcatactatacagttatattgctgcgacactcagagcaggaaaaatgaatctaatctcagggcaggggagtatcctggctgcaagtgccaaggagcacagggatctttccgggtgacgggaatggtctacatgaggaacaggttacctgttaacttcactgaaacagacaacatgcagtattttatcacaattaaatcatctcagtaatttttaaaattagcacaaaaaagaattttaatttaaaaaaatacttggatataagtttagtgttttactgttttcagttattcttcacatgtgtgagtgtggtatttccgatctcagcccaccaccaggtcacgtgtgcctccaaggccatacctggatctctgcagtaatggctgcgtgtaaggctgactccaaccctccagcagccatcaagctgcccaccagaagatcaatcaccaatcgatgacctggacttatgctcacttcattgcctgaaactgaaatagaaagtgtgtgccaatttgagtgaaacgccatcccctcccagcaccctgacccatggcctctcctgttccttccccgagcccacctccgcagggcaggagagcagagtgcccgggcctgcttctcagcggtgggcaacagcatggaccagccgctctgcagcatggcctgggaggccgactgctcggtgctcagcacgtctgcgctgcttgccagggtcaccaccgtctgcttcaggctgttcaggaagacgtccacacctattaaggggggggctggtactaaacacagtgacagctcaggtgacatgccctgcacagagcccagtacaaaggaagggccaacaaagcaagccactattttcgttgttcttttctggtattgatttaaaagtgcatgtttcaagcttggttctgtgctgacaaggaagtcggcgcgcactgatctgagtcttctccacaaacaagtggcctcccacacctgtctcatctgactcgctgctgttaccaccaaacacacagacaccagagaaaaacactgccatgcacaagcacgctggtcttgcgtaaaaaataactagactcgagtgccacctaaacacaaagttccatcatgacactcacgtgcatgtcgccctcggagtggggtgcatccttcctgcaaatgatgctctggaacctttgcagcaagggcaaaagcggggcgctggtgccctgggcggaacgctcattgtcagtctcctgtgccccgctgtcccacagctgaagcaacaacaggatggcagacaacatttggctaaagaagaaaacatatttattcctagtaaaaacagattaacttttttttttttcatggttgatcaaaaataaaagcaaacagctagatagaagtgaagaaatacttgggatatgaaaggaaacgaaagtaaagccgtggtagttaaatcactgaattgacactgagattttagcacaagacatcgccttctgctgataggaaagaccagttaagaagctcaaagagcacatttacatgaagatctagggtcttaaattcatggaataaaaataattaaatgaggaaaactgaaagaaaaaaaaagaagaacagttcccaggctagaaaactgagcataaaacaggaagtgaagaaaaggaaaagagagagccctgggacatggttctctgtagagcaccacacctgctgcagtcacacgattcagtgaaacgcacacaatgcaacaggtatttggatacagaggcgcttccccaaagcattcccggtctgcaccagccctcacctcagcatgcctctctgcacagccagctccagcaggatggccagggccaagtgctggtcctgtagggggatgattctggccctttagtgcctggtattccgtgaacatccctgaaatgaaaacagtggatgcaggaacgaagcgacctccagaaagacagcatgcttacaatcacagtaacacatttgctacatgctccctcccaaggaaggatgtatctttaatatttagaatcaagcttctgagacttgctactcaaatttattcacagatttttaaagtatacaattaatttacagaaatgtattttatttaaagtattcattcagatactatattacagtagatgacatactccaagtgtgtgaagcataaaataatttatctcattatccaaaacatgagtaggagaatatctagctatcttttccagtttcaatgacgtgtaagactataccagtatcaaccttctcccacagaattagagaaccaatttctaaaaccacttgaggatctggaggcaaaatgtctacactaatttctatctctgatcaaagattacctggttgcttactccatacccagctctccagaattgacttggccccatatacaggtgcaggagtttcatcttttttctctctgtcatccagatcttctttctttgttccacttggttcaacactatcatctgcagaattaaaatttttttaatctgtaaccgcttttcagaatgccataccatctgtcagtctctgcaaatgtccctccccgaaaagttacaacacacatcattaactgaacgtttgacaacttaaaaataaaatacatcaatcgtacctgtaacagatccagtataattttcataaagcaatatatcggccgggagtggtggcttacgcctgtaatcccaagcactctaagaggccgaggtgggtggatcacgaggtcagaagatggagaccatcttggctaacatggtaaaaccccgtctctactaaaaatacaaaaattcaccaggtatgatggtggacgtctatagttccagctactcaggaggctgaggcaggacaatggcatgaacccaggaggcagagcttgcagtgagccaagatggcaccactgcactccagcctgggcaacagagcaagactccatctgaaaaaaaaaaaagaaaagaaaagaaaacaaaccaatatatcaaattatttaaagcatgtcttccaaaatgatatttcattagcttcctagtagatttcacaacagagaaacttagtctttgatatttacctacttcagtttcacaccaattgcttttatccagtgagtcccaatgcatgtgcacccatgggaaaagggagggtgtagaacaggagtatgattcaaaaatcttttaactctttacaaggccctactccactgccaactgggaagcagtgctatgcaggggcactgtgactgatagcataattcaagagcactgggacacaaaggaaaagctgagaaaaatgactttaggccactgacaatgtcaagtttcagtcaaaaacaactgtcataaaactccttacacagtaagcgaagagaagagagaaccttaaccttgaagtgtaaacacactccatcacagaaggctgtgactaaatgtctaaacaacataattagaaaaatgtatctcaatcggtgaaagacatgatatcccatccagattacaaataatgagtatctaaaaatctctaaggaaacagttcctctgtttacaacacttctgacatcaaacgtatggacttttgcaccaagcagttctccagttctttgtgacacccagctatgtgtcccacaatgcaattcgattctgaaactaactacctagaattagcacagaccccacaggttaataacaggagagaaaaggtgaatgctgaaaaaaatatccaaagaactaatggctgaaaacttcctaggttcagcaaatgacataaacccaggcagattaaagaatctgtgcaaagcccacacaagataaatccaaaagaagccatgacaaggcacatcataatcaactgctaaacactaaggacaaaacccttcaaaaagtgccacagagtgtagatatataagaatgtcttgtgtggcctgaaatgaagactaaatattatgtgctgccttgacgtcggtaaaatcaagaaggcctcaaatagcctaaccacaaggtctcctccaagctctgctcccacagatcaggtcccaaagccaaacagcctccttatggcggagagctgactccagtctgctcatccctgccggcccagagttattcaaacaagccaatcacatcttcccatggaagcaaggtcatctcaccctcctgttactacaaattttgccttccacagcccctcgtggttcactctgttcccaagtgcagcccccgtgtggcatgcggtgtcccccaccccagggctgtgagcatgcatgactaataaactgctatttcatctgtccagtgtcggtgtcctacgttcagccatcccatatccctagggcaggaatcttctagggttataaacagaactttaatcaacctctccttggttattttactggttccatgatacagctttttctgtgcaaaagatctgaacagaaacttcacagaggatacaagagtggcaaagaagaacacgatactcagcattcttagccattacggaagtgcaaattaaaaccacaatgagatcccactagacttgttagaatggctcaactaaaaaacactgataacaccaagtgctaacaaagacacagagcaacagaaacgtgacagattgccagtgggaatgcaaactaaaacagccacttcggaaaacagttcagcacatgacccaactttcacactactaggtctttatcctagggaaatggaaactatattcacacaaaatctgtacagaaatgctcacagcaggattacaattgggaaagaaaaatggaaacaaccacaaggtcctacaatagcagaatggataaacaccatgtggtacatccaaatgatgaaataccattcagcaataaaaagaactattaatacacagaacaacaacaaatctcaaacatataactaggaataaatgaagatggtttcaaaacgttacttaaaatatggttccactcacatgacattctcaaaaagaataccctatactgatggagaacagatcagtggttgccagggtatgagaccagggaacaggtgataaaaaggagcagcacaagggagcttttggggtgatgacacgtctccgtcctgatgatgatgagggttacatgaatctatagagatcaaaatttactcaactagataccacaataaaataaatttcatataagttttttaataaaaaaaaatgttggctgggtgctgtggctcacacctgtaatcccagcactttgggaggccgaggcgaacagatcgcaaggtcaggatttcgagaccagcctggccaacaaggtgaaaccccgtctctactaaaaatgcaaaaattagccaggtttggtggcacgtgcctgtaatcccagctacttgggagcctgaggcaggagaatcgcttaaacctggaaggcggaggttgaagtgagccgagattacgccactgcactccagcctggaccgccaagtgaaacgtcatcacaaaaaaaccaaaaacaaaaacacaaaaaaacaaagaaaatatctaggtccaggttagggaagacagctggaatacagtctggtggaatcatgtcagagcagggagctgggtctggagggctggagtagggtgtggccccactctaggaaggaactaggaaacacatcctgggtaaagcaacagcagagtctcgttctgcaacaggtgagcatttatcctgatctgagaaactacatgcaaatttagtatgtctcacttagcctcttattttccttaacaacatggaaaatgagagaacaaacaattcagaaggttaagacatgaaacacattgaattcagaaatcatacacagaaaggtaggaaataaatgggggataaaagcagctaatgaaaagtgaaaatgggccaagtgcagtggctcacacctgcaatcccagcacgctgggaggccgaggcgggcggatcacttgaggtcaggagtttcagaccaacttggccagcatggtgaaactccaactctactaaaaatacaaaaattggcccggcgtggtggcaggcacctgtaatcccaacagctcgagaggctgaggcaggagaattgcttgaaccagggaggcagaggttgcagtgagccaagatcatgccactgtactccagcctgggcaacagagcaagaccctgtctcagaaaataaaacaaaatattcatagccttaataatagaaaataaaaacatttactgaatgccagaaaatctccctaaaaaccccaatcagttgggatctacataaagaacaattatgctctgctttctaaccacgatttttaaaagaacaaaggacaaatatattcatcaaatatgggccgggcggggaggctcaagcctgtaatcccaacactttgggacgctgtggcgggcggatcgtgaggtcaggagttcaagaccagcctggccaatatgatgaaactccatctctaccaaaaatacaaaaattagctgggcatggtgaagggtgcttgtaatcctagctactcaggaggctaaggcagagaactgcttgaactagggaggcagagaactgcttgaaccagggaggcggaggttgcagtgagccaagatcatgccactgcactccagcctgagcgacagagcaagacaccctctcgagaggaaaaagaagcaaacaacaaattcatcaaaggtaataaataaaacatatactttggatttttccatgtacttagcttttcttagagcatcttttagaattattgtttcacaaaaaacacttcgggaaacgttttaatttattaacaaatactggagggctagaaagaagaggttaaaactttttaaaatatacagaatgaatcacagatacgtgaaagaaaaaagaaaaaaaggttgctgactcctgccatggaaggcactatcatatggacactcttagcctcagcatccggaggtccagaaagcgaaaatttcaagtcagagagaattctatatataccatttatttggaaccttcagcccttaagatcccaacatcatgacttcagtttcaacacaattatccttagaccttgtactggctacaaacacaaaacaaatagctcgactgaactaactcacctctccagaaacacaaacacaagacctcataaagtcagtgagtttctacaggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttgcctactaatagatctcaagtttcgtgcacttacaagaaactaattaaaaggcagccgcgcacgatctacaaaaacagccataaagactgttacattttaagttacaggaaataaacctgctcctctaattcagcaagatacaactgacttccccttacataccctaaaaaaaagctttacacgagaaatttaaacatggaagcagaaacacaccaagaaaaagacatgtcaaaccccacctgtatatctgttttcaaccatttggagtcgaggcgagcccgggcagccaaacacaaagattcagagggcatcttttctccagcttcctcccaggtctcaggcctgcaagtaaacacatacgttgaagacctaacgctttttaatagtttacaaagacactcccgaaaggttcaatgcagaaaggaaaaaagagagagagaacagaaaggggggagagaagagctggtggaggggagagaaggggagagagggaaacagggaagagatggagggagagggaggtggggaagggaaagcctccttccaaggtaggcagggtgtgccgagtttctgcaccacgctgacgagaccttgagaatggacggtcacaggaagccaagtcacaatgtcatccccctgccctcaaatccaagaagtacacacataacagggagcccatcgttttaacgacaaatgacagcagcatgaatctgccgctttaccccacagcagggcgcgtgcgtgaaacaaattactcaaaaggatcgcctgcagaaaaacccacagccaccaccacttaagagatggagagaggcccgaggctgccccgcgggtggtccgcgcaggccccggtgcggccgcgcccacgcccgcctcccgggctcggccgcccgccagccccacgcccgtaccgcccccgccaccggccgcccaggtgccccaggccaggacctgacgcgcagggccgggccgcctcgccccgccggcgtgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccctggctgcggccaaggccaacagcgggcgccggaaggcgggatttccgccgcacgcacgcactcccgcactcccacgggagactgcttggcccggagcgctcttgatcacgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcatggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagctgagatcgtgccactgcactccagcctgggcgacagagtgagatcctgcctctaagaaagaaaaataacggccgggcgtggtggctcacgcctgtaatcccagcactttgggaggccagagcaggtggatcatttgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggtcagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaaatgctgggattacaggtgtgagtcactgcactcggctaatagtaatgaactttgaacagaaggaaagttgttattattttcttggttatgttctatttatattttctaatttttctaaacatgtaaagataaaattctaaaaactcagtaagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcagaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagatacttgagcccagaagttcgagatcagcctgagcaacatggcataatccaatctctacaaaaaatacaaaaattaggcgggcatggtggtacccacctgtggtcccagctatttgggaggctgaggtgggaggatcatgtgagctggggaagttgaggccacagtgagctaagatcgggcccctgcactccaccctgggcaacagagcgagaccctgtctgaaaataaaaaaaaataaaaaacggggttgagagacaaaaaaggacatccttttttttattattatattttgagatggagtttcgctcgttgcccaggctggagtgcaatcgtgtgatcttggctcactgcaacctccgcctcccaggttcaagtgattgtcgtgcctcaggctcccgagtacctggcattacatgtgcctgccatcacgcccagctaatttttgtattttggtacagacagggtttcaccatgttggccagggtggtctccaactactgacctcaggtgatccacctgccttggcctcccaaaatgctgggactacagacatgagccaccgtgccagccgaaaccttcattttaaaaaaggctgggtcaggcatcatgcctcatgcctgtaatcccagcactttgagagggcaacgcaggcggatcacctgacgtcaggagttcgagaccagaccaacatggtgaaaccccgtctctaccaaaaatataaaaattaggcgggtgtggtggcacacacctgtaatcccagctactcaggaggctgaggcaggacgattgcttgaatctgggaggtggaggttgcagtgagccaagattgtgctaccacactgcaaccagggtgacagagtgaaacgccttctcaaaaaatgaataaaggctgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaaataccgcatacaatatcctcttgagtagaatcataatttagaactctaaaaatgaccggaaacaaaactgtccaagtttgtttaacgtaatgtgtttcaacttatttgactagaaaacccttcattcgtgcaacacttataaatatcccatggcaaatctagttttctatgaataatgaacgaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattgcagcctgggcaacaggctgcttaaacctggaggggcagagcttgcagtgagccgagatcgcgccactgcactccagcctgggcaaaggagccagactccgtggcaaaaaaaaaaaaaaaaaaaagagattctattcacaatagcaacaaaaccctgagaatatatctagcaaagtatacacaggcctttcatgaagagtattgccatagcctgaatgtgtctcccaaaattcatgtattaaaacttaattcccaagatgatagtactaagaagtggggcctttaagaagtgattaagacataagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatggcactatgaagggactaagacaaatataaaaattacccagggacttaaaggaagaactgactaaactgaaatatatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtactttgggaagtcaagactggaggatggtttgaacccaggagttcaagaccagcctaggcaacatagcaagatgttgtctcaaaatattaaaaataaataaataaataaataaaaagaaggttaagtatgcacattttgttgtgaatttcaattttatagtgattttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatatattttttttgtagagacggggtttttccatgttgcccaggttgttctcaaactcatccacctgccttggcctccgcaagtgagatcacagacatgggccactgcgcccggtctagtgcgcttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaattgtagagatagggtcttgcttcgttgcccaggctggtctcaaactcctggcctcaagcaagtcttcagccttggtctcccaaagtgctgagattacaggtgtcagccattgcacctggccaaaactgtaactatatatacacacacacataactacatatatatgtgtgtgtgtatgtatgtgtgtgtgtatatatatttttatataaaaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttgtgggatgcatatagatggttaaaaaaattactacagtgaagcaaattaacgtatccttcaactcagatagttacccgttttctttttgtttggtggcaagaggagcttaaaatctcatttagcgtgaatcccaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctatctttatctctgtctatctatctatccatccatccatccatccatctatctatctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaaccacaatttttgttaaaaaaaattaagaaaattgtatgatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaggctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatattttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttagacgattctctccaaaaagtaagtcagcatgtcacacagagagacatgaggatagatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccgcctcctgggttcacgccattctcctgcctcagcgtcccaagtagctgggactacaggcacccaccaccacgcctggctagttttttgtatttttagtagagatgtggtttcacctttttagtcaggatggtctcaatctcctgacctcatgatccaccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccagaatcatagaccttgcatagaagctggatcatgaagacagctctggaggaacacacaggtacacacacacagacacacatatatataaagtatacacatatatattttttaaaagcttttaaagcaaaagccggccctgcccctctcccagagttggcggcctctcccctctcttagggtgggtggggacagtggttgcatgggcagctttccttgtgagccaaagatccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgccagtcagccccaccccttcagcaagcagcccagtctctgccctcaccaatcaccccagggtgactttgggcaggtgaatcctggggctccccgctcctttactgggccctcatctcctgccaccccaagcttgacctcccagggctttttgggctcacatctccaaggacctgggtcccacagccccagaccccaccctcaccagtcatccctggctgactttaggctggtgaatcctggggctccctgctgctgactcttcccttccctcctgctgcctcaaggtggacctccctaggctgtgtgcactggcgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcgagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagtcagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaacagtataccagacttctctctgaaatgaggcttgggttgtcctctttctgataaattcccagatttaacagaaaggctgccttctgccatgaggacacattgatataaaagtttgagaggtacaggtgcacttcttcacactaacagacgtgtgaggatgtatgactaaaccacatggcatacagttcctgcctacttaatgtttacttttctagctctgcctctggttttggtccctggcagctgatgattcttggtaaaaccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagatgtggatggactgttgggtacctgtgaagaattctgggtttgaatcctgcctctttgtctgctagggatatgaattagggcaagttgctagacctcatcaggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccgcagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcagggcagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccctgtatttctgccatgactcagtccctaatttgctctttgattctggacaagccacctctcctttttgggctcatgtttccagaggaagtagtgagtatcaaaggtctctgttagctctcgagtctgagatttaaaggcctcctagaatggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatattgctgtcctctcaagagattccagattcagaccttgagttctgtggctgtgggcaaaagccaacaaagacccaaatcctctgtccttgggagcttgaggagagtttaccagttcgagttcccactgggtctgagaactttgcctttaaaatccattcctggtccctgcctaccacttcctgctctggggaatagagttgagggggccaccctccatcaccttaatgtgactctccccacagaaacaacagaagaaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtctctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagtttcctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggaactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtctgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtggttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctccccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtacagccagaggtggtcatgggtctgggctttgtggaggtgggggcagagagagagatggtagcatgtccagcctccagcccctctctccagggccctttccccctgtgctttgggcaggtttgctcgttgaagaaggagaagaagcatgataaatatcgggtagagaagctggagaggagcttgtccaaactcaaaaaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctacccatctgggtgcgaggaatcattagcagtgaggctaagtttgaggagccggagaggagctgtgcgccaagaggagggttttttcttttcttttcttttcttttttttttggaatccagaggctcttattatctgcttcctttctcagctgaacctctgcccccggagcccccagcagtgccctctgaggtggagctgcagcacctgaggaaggaactagagagagtggcaggagcgctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggcaccagcctctggggaggggaggtgccaggccagaggcagctccagcccaggggcaggtgaccccagcaccctccagggcagtcctgtggctgtttcttgcttcctgccctctgattttagaggtgggtagccctgggctcctcccaggtctggacatcatcattccagctagagacatggagcacccccaatcacaggggaagagacagagtggtataacagtcttcttatgccagacgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactccggcctgggccacagagtgacactctgtctcaaaacaaaacaaaaagactccttagattaaaactggattccagcctcagttccactggtcaccattcaagtacttcacatctctaagtctctgtttctttaacttcaaaaggaagttagcattttccttacagaggtgctgaggattaaatgagataatacatgggaagcattaggcctgtagcacatttagcagatggtggttggctcccactacttttctaccattctgtggcctacagttgaaatggtgggaagaggacatgagatttgaggctggggaaggaggcatggggttctaggaaagggaggcagtcacttaggcctggagtaaggggccaggggcctgggcaggcgacagagccccacagtgccctcgctaccctattaatgggcccagaatctgcaaaccagccaccacgtcccctcacacccagggtcttcctgcaggtggagctgaagagccaagaggctcagagtctgcagcagcagccagaccattacctgggtcacctgcagcagtacgtggccacctatcagcagcaggtggccacctatcagcagctgacctgtgagaaggaggcgctgtacaggcagtgactgcagcagacccagctaatgaaccagctgcagcagcaggaagcttggggcaaagcggtggccgagatggcctgccaaaagttgcaggaggcccaggggagggagctgccgaggatggggccgtgagggggacgagctggcaaactctgtgccttctcactctttcctggccccttaggagcgtctggaagctgccagccagcagaaacagcagctaacggcccagttgagcctcatggctctccctggggaaggtacgggagaccgctcagaggaagaggagagagccccaggaggaaggggggactgctagcagcataggattgaggagttggaagagacctttagaacagctggtcattatactaaccgggtgcctgcactaagttcagcatcaatatggtgacctcctgggagcggggggccaccaagttgcctaaggatggctgaactggccgaggtcagaaagggagcaggtcagaactcccacatcgaccagtagtgggaatatgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaagacccctctggccaccccccacaggacacggaggagaacatctggacagtgagggggaggaggcacctcggcccatgccgagtgtcccagaggacctggagagcagggaggccatggtgagcctgactccccctgcacccattttgccacctttctctgtggtccctccaagacccctttatgctcttcgtttccctgccttctgatttctctggaccctcaccccttccgagagccagtggtcagacaccatttcacctgtgaccaacatgtgcagtctctggggccccaagggaaggggctgcgctccacctctctgccccatttcttctgtgtatgcccctagaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagcggtcccagccccagggcctgggggcgagtctgtgagtggggagacccaccgggccctgcaggaagtcatggagaagctggcccatgccggaactcacctccgccttctccatgacttgaaaatgccacctgagggcaggtcgctggcgagatgtgaccccattattttggctccagagcggctttatggaccacctggaggagaaggcagacctgagtgagctggtggagaaagaagaacttggattcttccagtactacagagagggatgccatcagtgagtgggaggccagggcatggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaagtagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctcaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcatgattgtaggtcattagcgtgcatattgagtttgcccttacgtggtggggttcaaacacacaaagacccactatttgcacaaaactattcttgctggtttggaataggctgccatgtgtttttaatgttattgcagcatgtatattcattacagaattcagataaaatttgcctatgttctgctattgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagctgcagcagttgtactcttttttgatgacctaaaaagggcttatttctgaggaatgaaaggttcccatcattgactatggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagtttaaatgtccctggaacacgcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcagttggcatcctcatgatacttttataaatacgacattaacaggagagcagcagtacgattttgccgatggaataacagatttgccggcaatcactgaaagagtgcaaatatcgggtccttgtgacttcaacggactcttccaaattgtatgaatgtatcaatgtattagataaacccagtttcagaatgataaagaaaaaatgttagaccaaataatgcggctagttaacagtggtacgatttctagcccgtgggtttaaaatgcacttaaagtcctgtccttgccttttattttctgaacttgatgtttttgcattctttgagttcagtttaaagacaactacgagcatctgcaaccaatctgacaataatgtgttcatcaggtgcctatggattaaatcacatactggcatatttaagctgaatgtcaatctggaaaataaattgactatattaacagaaataccactctttgtgtagatatttgtcgtatatttaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagaaggcaacattggaaggttagagttcatcagaaacagaattctaaaatgtgagttcaattcaataaatttgaatttctgtaggaagaatcaaatcaccgatttaaagagtgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaatggtgggaaggaaaagtagagaaagaaatgccaattccagtccaaagctttatttgccaagttttcttggaatgaattttaccaatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcttcatgaaaggcctgtgtatactttgctagatatattctcagggttttgttgctattgtgaatagaatctcttttttttttttttttttttgccacggagtctggctcctttgcccaggctggagtgcagtggcgcgatctcggctcactgcaagctctgcccctccaggtttaagcagcctgttgcccaggctgcaatgcagtagcatagtcatagttcaatacagcctcaaactcctgggcccaaatgattctctaagctaatatttttaattttttagagatggagtttcattcaaggatcactaaaggccagtgatcctcccgcctcagcttctgaaattgctgggattacaggtgtgattgagccatggagcctggccagacatgggctattgattctcgctgttactcttttccctttccttctaatccttgtattgggaagaaaacagtatggaaattttatttcttcattttattgatacgtagatctctgcttagaagacaattttagttttaaattataaatgtttcgttcattattcatagaaaactagatttgccatgggatatttataagtgttgcacgaatgaagggttttctagtcaaataagttgaaacacattacgttaaacaaacttggacagttttgtttccggtcatttttagagttctaaattatgattctactcaagaggatattgtatgcggtattttcaaaccaactcatcctgcgtcaggttgtggttacgctttgggagaggaagctataatcttatactgagactgtaatgaatgtattaaggtaattttcgtagctttctctttttggagttacctgagaaattatgacacccttttccaaacaggccaacctgctttgcaaacacgatttccataattttaacaatggtgaggccaggcacggtggctcatacctgtaattccttccagcactttgggaagcctaggcaggaggatcacttaagccaggagttcaataccagcctgggcaacatggcaaaaactcatctctacaaaaaatacacatattagccaggcgtggtggcacacacctatagtctcagctactcagaggttgaggtgggaaaattgcttcagctcaggagctcgaggctgcagtgaacggtgatcacgccactgcactccagcctgggtgacagagcaagaccctgtctcaaaaacaaacaaaacaaaacacaaaccaagggtgagagagatgttagatgtttttgtccttgttacagatgtaaatgctcagttggaaagagggaactatttagagtgaaaaagtttcggtggaacacacacaaaaataggaagatcaggtataactgttccaaaaaaaagagtatggcagtatagaagaaaaggtctccatgaaaatgcagaagaacaatttcacagctggtgctggcatttcagagaccttgagctgggaatcaaaagatgggaatttcagtctcggatgtgccactccttagaggtttaatatctactaaacccggcgggctccacttggtggtgtttgctatttaaaaaaacaaaaacatgtggcaatgatcttccacgtgattctgacttgagccccacgcgagtctgcagacttacccttccactgctttgcccttcaagtttgtgcccattagcaaagagaaattttctctttgggatcactgctgtgttgatctcaggaatatttggcgttgaatttaacatatttttcatatgtgtgtgcaatagggaggctgagaaagttgtcttttttttaaggtgttcatttttggggtacaggtagcagcctgctctacaatccacacagaagctggaaatagcctctagagaatttccacgtttagagaagataaatttatacatttgtatctaatcaacattttttagctaacatagtagtctaattatactatgtataattatactatgtataattatgggtactgaaatgacacctggcatatgctgtatgctgtgttatatatacatatatatttacacatatacatatatattacacatatacatatatatttacacatatatatttacacatatacatatatatttacacatatatatttacacatatacatatatttacatattttacatttacattttacatttattttacattttacatttacatttgacattctacatttattttacatttacatattttacatttacaaatatttacatattttacatttatatatacatatatttacatacatatatttacgtacatatttttacatacatatttacatgtgtatatatttacatacattcacatacatatttacatatatatttacatacatacatatttacataatatttacatacacatattacatacatatatgtacacatatacatatatttacacatatacatatactatgtataattatgggtactgaaatgacacctggcatatgctgtatttaaaaatgtgaggttcagtgagaacacatggacacaggaagggaaacaacacatactggggcctgtcagggcgggtgggggaggagcatcaggaaaaatagctaatgcgtgctgggcttaacactgaggtgatgagttgataggtggaccaaaccaccatggcacacgtttccctacgtaacactcctgcacatgtaccctagaacttaaaacaaaattttaaaaataataaaaaataaaaatgtgaaattcagcacataaactgttggttttattattcatattttcttaattcagaaattattttctgaactatggtttattagataattttgacgtaacaattttttaagaggaaatttaagttttactttttaattggggctcttggttctttttaagaaagacagagataaatcatttatacatttaattagaagagactgggcttgaatttttaaaaagtactagaaatcgtagccactatatatgttatctttgaaatgttttagacaataattacctaaacaaggagcaaataagttaaacctcttggattttaataagaactaaaatgtacagttgtattttctggttttttaaattgttacagtctaaatttattcttcctaatgaagaaatgtatgtgccgtcaatatcaggttctttgtgggtactcacagttccctttgccttttacgcagtgaatgtgggcaacatgcgtggaacagaaatgatgtcgttttctttcttttgaatatcactatgaatctaataattcaaagattcctaactttctgaatgccattattaattggattcacaatgacttaccaggtacagagttgtcccgtgtgtcttggggtgaactactgagagtggtatgagggaagcgattctcagctagcgctgagtggggccacttccaaagaggtgatggggtaagaagcacacacaatgtggcattttcactgcaaagggaggtttgtgctgcctctcctcctgtggcaggtctgctcgcaggggaggctccaaagtttggctttgctgggtttggcatgtgagaactgatgaaatatctgtatgtagtatctttcaaggatttatatcagttggatttctgtgtaaatttgcatatccctttgactgctttaccccatagaagctttgtatgcttaacaaaatctgtaacttttctgtcactttctcatttagcatctgcctttctggctttttactttatctttttattattgtttttagtttaatgagattatggttagagagaaagatgggtgcatgattccgcttctttggaatttgttgagattttccttatggctcagtacatatgtacttgggggggtgaatgctgtcactttggagagatatgttttttctgtacattaagtcaagcttgttaattttctagagagatgtaaatcttctatgtctatgctgattgttttttgtctcttttatcagacactgagatatgtatttaaattgccctctgagggttgcaattttgtcatattttgctttcatgtattttgagtgctagttattagatacattaacattttagattaccttctcccttggtttattagaatttttatcattatattgtggccttaaaaaatctcccatattgctttttgcccaaagcctattttatctgataataatatagcttccaacccttctttgggttaggtacatatgacaggtgtatcttttttcaatctctctcagtctttctgtgactttatgttttagatgtcttttcatactgtttattttctgttttttgtgtttttttgtgtgttttttttttttgatacggagtcttgctctgttgcccaggctggagtgtaatggtgtgatctcggcactgcaacctctgcctcctggattcaagcgattctcctgcctcagcctcctgagtaactgggattacagatgttcaccaccacgccggctaatttttgtattagcagagatggggtttcaccatgttggtcaggctgctctcgaactcctgaccttgtgatccctccgcctgcctcatcctcccaaagtgctgggattacaggcatgagccaccacgcgtgccctaattctgttttatagtcattttctcttaattattcagtctatttacatttattgtgattgttggcatagtttcttttataactttcatcgtattttgtgctatttgttccatctgtttttatttcttcatgtcttttttgtttcgtttttgctaattccttttatattcatggttattctgctcttgaaatgtatgctatgtgaatatatttgtgagttgacaatactttattagcaattaaatatactatttctctttttttttagaacttgctcaaatgttacataacctcaatatccttagtatctaaattaaactgactttctgaacaatcatcattttaaggcagttaccacgatctactaaaaaataaaaaaaaattagccgggagtggtggtgggcgcctgtaatcccagctactcaggaggctgaggcaggagaatcccttgaccctgggaggcagaggctgcagtgagccgagatagcgccactgcactccagcctgggcgacagagagactccgtctcaaaaaaataataataataataataataaaggaatttaaaaaaagactgggtttaaccatgttgcccaggccggtctggaactcctaggctcaagcaatcccccacgcttggccagtccaaagtcctggaatcaaaagcgtgaaccaccacgccaggccgatcacgcctgtcatcccagcacttggggaggcggaggtgggtggatcaccggaggtcaggaatttgagaccagcctggccaacatgatgaaaacccgtctctactaaaaatacaaaaaaaaaaattagccgggtgtggcggcaggcgcctgtaatcccagctactcaggaggctgaggcaggagaaccaccaaaacccgggatgcagaatttgccgcgagcggagacccagccactgcactccagcctgggcaacaagaaggaaactccgcctcaaaaaaaaaaaaaataataataataagagacagattttcaccatgttgcccaggcaggtctggaactcttaggctcaagcaattccccacgctcggttgtccaaagtcctgggatcgaaagcgtgagccaccacgccaggctgatctatttctttctgattaataaattgggccgggagcggtggctcacgcctgcagtcccagcaccccgggaggccgtggcgggcggatcacctgaggtcgggagtttgagaccagcctgaccaacatggagagacctgtctctaccagaaaaaaaaaaaaaaaaaaaaaagagccgggcatggtggctcccgcctgcaatcccagtcactcggaggctgaggcaggagaaccacccaaacccagaggcagaggccgcggggagccgacaccgcaccactgcactccagccctgcaacaagagggaaactacgcctcaaaaaaaaaaaaagagagagagagagagaccggttttcaccatgttgcccaggctggtctagaactcctaggatcaagggatccgccacgctcggccggtccaaactcctgggatcaaaagcgtgagccaccacgccaggccgatccttcctgtcatcccagcactttgggaggccgaggtgggtttacctgaggtccggagttcgagaccagcctggccaacatgatgaaaacccatctctactaaaaatacaaaaaaaaaaaaaaaaaaattagatgggtgtgctagcgggtgcctgtaatctcagctactcaggcggctgaggcaggagaatcgcttgaacctgggaggcagaggttgcagtgagccgagacagcgcaccactgcactccagcctgggtgacaaagtgagactccgtctcaaaagtatatatatataaaaataaaaaatgaaataaaaataaattgggtgtgtgcgctggctcacgcctgcaattccagcatccccggaggccgaggtgggcggataacctgaggtctggagtttgagatcagcttgcccagcatggagaaaccccgtctctaccaaaaacaaataaaaaaaaattagcagagcaatgttggtcaggcctgcaatcccagccactccggagactgaggcaggagaactactaaaaccctggaggcagaagtcgctgcgagcggagacccagccactgcactccaccctgggcaacaagagcgaaactccgcctcaaaaaaaaaaagagagagagagagagagagagagagaccgggtttcaccatgttgcccaggcaggtctggaactcctaggctcaagggataccccgcgctgggccatccgaagtactgggatcacaagcgtgagccaccacaccaggacgatctattcctttctgattaataagttgggccgggagcggtggctcaagcctgcaatcctagcacctcgggaggcctaggcaggtggatcacctgaggtcgggagtttgagaccagcctgaccaacagggagaaaccccatctgtaccaaaataaaaataaaaaaaaaatacaaaattagccgggcttggtggcttatgcctgcaatcccagccactctggaggctgatgcaggacaacgaccgaaacccgggaggcggaagtcgcggcaagcagagacccagccactgcattccagcctgggcaacaagagcgaaactccgtctcaaaacaagacaaaacaaaaagaccaggtttcaccatgttgcccaggcctgtctggaactccaaggcacaagcgatccaccctacttggccgtccaaagtcctgggatcacaagagtgagccaccacgccaggcagatcaaagcgttgagctgaataaagagttatcttttagcattttgtggagcccgggtagatctgtgcagggggaagcatattacagaagcgagaaacagagagttatttaattgaagcacgcattatgttttttttttttttacgtttttaggaaaaatatgttttgtgacttgcatttgtttgtttagtcaccttgcagttgcacagttagggaattagggttttgataatgcctgggaagggagcgataaggctcactagccataggaaaacaggtagtttttttaaaggactaaggctctttctcattctcagggggaattgggttttttttacatacagctgagtttttgcttacacattttttcatttcttttaattcctgttccaatcccagcatccttgcggtgcggtttcccagcggctctcttgccttgcagcttgtgtcgggagttgcagacagccatggcccatgggcctggcgctgacggaccctggagcggtgtctgagggaggtgggcaaagccactggctggcccgagtgcatcctcacgtaagtgcacagatcccgggctcgggtgcgactgcggtcgcacgtggacacgggttgcagacccctggcaaattgtggagctgggggaaggtaaggggaaatgtaaatcacttttccccacatttcagaggacctaggctatcaaaattttaaaaattgttaaaacttttacagtatggatctctcagttgaatgttattgaaatcaacctaacctcagttattcacgcctataagctccccttgaggcttattacggcccccatccccctacacacaactgtgttggtttctccttccgcctgtgctcctaaagcactcagtgtttacctgccatcatactttattgaaagcacaaacttgtcacttgtctgtctaccccactaagcttcttgagaattagaactttcatgtctcttcccaacacaaacgttttatgtgtattttgttgaagaacttcaaatatgacctataaaattatgactcatttatgtttcaaactccaacctctcccttgagttccttgctcacaagcaactccagactgagcttagttggaattcagtagcgcacaactgggatatccgcaccgtacggcttttaacaattttttaaattttggtcctctcagcatcacaaattcaccgtgtccaaaatacagtagaatgttgtttctacccacctacactctgccatccgctgaagtcctttccccttgctccaccactcaagccttgcctatcgcagtaaatggcagttctgtctctccagttgctcgcacataaaactaggctgctattttgatgtcttcacttttctctattctgtatctaattccttagcaatcctgtcagttctacctccaaactgtactcagcatattcactgctctaactccagcttaaatcaccatcatcctttgcctggaatgctgcatcaaccttctaatcactctactttcctcctcctccttcctccctttcttcttccttcgtataaatcatcatttcatccttctgcttaaaatcttctcacattttcttattacacttaaaacggcaaactcttacccttgagccctgcagaatttggctcccatcagtctctccgacttcaccttctgcctccttcacgctatagccatgctcacttttttattcctcaggcttaccaagctcaattgcatcttagagaatttgttcttgctgtttcttctgcctggaatacatgtttcccaatctttataagactatacttgtctgtaagtttcacctcagatgtcacatctaggagaggttttccttgaccactgtaagccaaagcaaatgttgatcattgagtgaataagggaatgaatgaatggagtggtatataatgtagcagagtagaaaatttaaggctaattctctatacatctccaagcaaatagatttgtaatgcttttcctgccaacaatctatacagctgattcacaaatacttggttgacaggttttatatatcactgtggctcatcagcttatatattgttggggccagaatctatacttacactttattcaaatttgattttacagaagagttgaggtttttatttttcttttaattaagagggctgtgaaattattatctataattctaaatctcatttaattcctcccaataggtttcaagctggattggaaccaaagttcacttctttaacgaaagtgctttatgactttaataaaacagtagagaatggtagaatccatggcagctctttacaaaaacttgtgatagaaagttttgatgatgagcagactttgcaacaactggaattgcaaaatgaagcaattttacagtgcttccagaatgcggttagtgaaagaaagatgaagatatcagtcttctcccagagagtgaagaacaggagcatgaagaggctggttcagaaacagaggctgatggccaggaggacctagaagatttagaggaggaggaggacgtgtcagatatgggtggtgacaatcctgaaatgggtgagagagctaaaaactcaagcaaattcagggccaggcgcggtggctcacgcctgtaatcccagcactttgggaggccgaggcaggcggatcacgaggtcaggagatcgagaccatcctggctaacaaggtgaaaccccatctccactaaacatacaaaaaattagccaggcgtggtggcaggtgcctgtagtcccagctactcgggaggctgaggcaggagaatgccatgaacccgggaggtggagcttgcagtgagcctagatcacgccactgcagtccagctgggcggcagagtgagagactgcatctcaaaaacaaaaacaacaattacttaactttaggatgctccaataatcaaaattgatagtggcttgtgaacagatagattacttgaatagaatagagcccagaaataaacccaaatgcttctgggggagtttggtacattataaacatgacattttaaatcaatgaggaaaagaaatcatttgcagctcaccccaccatacacagcaggaataggaagtcattggcagaataaaaagatggtaagaacagaacagaattgtagaacagtacatttcttgcttccccacttttcaaagtattttttgctttttcacaaatgtaagtgtaattttattttctaaatgtatactaattcttttcttctctttcttagatgaatgacaaaaattacatctttagaaaaagagttgttagaaaaaagccttggctgcatgtgggggaagtgacagcacagaagagaccagagaagagcctcctggaggagagcctgcactttgaccatgctgtccggatgggtgcagtgctcttttctgcaaagtgttcacttctctgctttttctgtggtcccatttcatagaaagatttggggtgatgtttctttccctcaacttttattttgaaaacttgcaaacacagaaaagttgataaaatcatacagtgaacatctgtatgctattcaactggattcactagttaatgttttgtcacacttgttttctgtcttctgcgtatggaagattgtatatgtgccctttttccccctgaatcatttcaaagtaagttggcagtatcagagcatttcactgttaagtactttcgcagatatcttctaggaaccaggacttctcctatataatcacaataccattaatccacccccaaaatttaacatcaatacactaatgatacctactgtatagattataatcagcttccttgcagcaatctgtttagaaggcttgcatcctgtcactgtccactgattaaattttgaactctaacttgaaaccctggtcatctcattgccttcttgcttatacccattaagtcaaaaggagctctcattttatttcaacagaaaagagaatggaaaagaggggaagagtccctagtaccttggataaagtatgagcacttactaccatatgtattctagttctgtagttttcaaacttcagggagcatctcaaggcttattaaagcacagatagctgtccttccccactttctgattcaggaggtgtggggctggcccaggaatttgcatgtctaacaagttcccacgtgtttctgatgctgagggtgtaaggactacaatgcgtgaatccgtggtttagtggatccacctaatgaatacatgttgtatttcctttggcacccgtgattacagaggaaacacctttcaactggaaggtatcattaaacagaggataagagatcaggtcagtaagaattaaatttcacttaattgaaatgtcactcaaatgtttagaaataatatgacaggccaggcacagtggctcatgcctgtaatcccagcactttgggaggccaaggcagacggatcacttgaggtcaggagttcgagaccagcctgtccaagatggtaaaacttcctctctactaaaaatacaaaaattagctgggcatggtggtgcatgcctatagtcccaggtactcgggaggctgaggcaggggaatcgcttgatctcgggatatggaggttgcagtgagctgagatgcgccaccgcactccagcctgggcaacagagtgagactccatctcaacataaataaataaataaataaataaataaataaataaataaataaataaataagataaaaataaaaataaagggaagatggggcagctttgtgtattgcatgtcctgaaaatgggctgatttctctcaagaggcagggatttaagctctgtagcctatgtgggatacatacaggagaaaaaagaagaaaaagaaaagaaatgtaaatataaataaatgaaaataacacttttccatgattataaaggaaatcacattgtttttgtaataatttggatgacaaaatgtaaagaaaaatctttaattttgccactcaaaacattccggtttgttgcttttcacactttttatgctgtaaacattttaaaaagtagaatcacaatacatggtcttttgtcacttactatattttaagcatgtttctatggagaaatataccctggcatcatcactggatgtatgttaagtgagtcattgccaccccagaggtggatttccttctatatatattttaatggactcgagtcaggatttttgcactgaattcatagaagtagaatttctagaggaaagtaatataaaacagttttaggatttttaaaagaaatgttcaaatcatcctacaggaaaattggttgagtttatgctcccaccaacagggacagagctccaggttcccccttccatttgtcatcttcgctggtctttaagcagaaaatctcattgttttcattacctttctttgatttctagtgcttttgaatctttttcatttgctcattggccatttttattcttgtgggaagtgctggtttctccattgcccattttctgctgcaaatcattcatttttttttctgagtaattttaaagatttctttataggctaaggctacaaacctttaatctgtcattgaggttacaaagatcttctcccagtaagtaatttgtcacttcactttatttatttattttttgctagcaaagcaccaaagtcaaatttcacttaatttttatcctgctgaatgaacacattttaagttagtgattttagtggaaacaggagcaggacagaatgtaataattagatctcgctctgtcaccccaactggagtgcagtggcatgatcatagctactgcagcctcaaacttctgggctcaagtgattttcccacctcagcctcccaagtagctctaggactacaggtgtgtgccgccaagcccagctaatttttaaattttctttgtagagatatgaattcgctatgctgcccaggctggtctttaactcctgacttaccccaccttagcttgccaatatgctgggagtacgggcgtgaactactgctcccggccaagagcttactttggtttgctagcaaggttcttggtatctttttatatttgaggctttcgtgctagtgctgaagtattacactcaccatctgaggtttacaggacttttgttttaatattgaaccgagggaactgtttagttttgcatctttgcaggtatacaaaatgtgcctaccaggactctgctttatatccattgaaaagcaagaagtaatacagtaaaagtttgcctggctacaggctttggaagaatggagtattctggtttaattctattaacttggaaggatgaaggtggaaaaaattcaaaactttaatttcctgttgaatgcaatttgaaaatatagccaatgagtccacttttcttctctagtaagtttggacattcagatctacttggtcttttatcatagaactcctagtgcgcctgagtcttacgttgtgaaaatccttttctaaaactttagatgtaagaggatagaaatgatattggatgagatcaggctggatgagaactgatacctgtagatatattttttagatgaaatctctgattgccacacgttttcttattgaactcataaaaataaaacacactggctggagggtggaagtaggaaggagatttatgtcttttaattgcatgtcattgtttcatattgagacagaacatatagtatccctggctttggacctacagaaggaaacacatttttctacctgctgtatggcagaggttcctgagcacctggagggattattgcagcacggattgctgggccctactgcagagtttctgattcattcatgtctagggtggggcctgagaatttacatttataagaagttcccaggtgctcctggtccggagactacatgtttgagagccacccttacatactaactgtaaattgtagaactctagaaaaaagcgtagtttggactgggagaagaagcacacaggtaatggagcaaatcatgaaaaagtcaacccttgatcccaggtaacaagcaatacacagtgacataacacaattcttggttttcatgattgcaagtcatagccaagtatcgagtgagaaattcagtttcattttcagggcttagaggccaggtgattctagaaaaatcggatttagtgattaactcatgagagtaggagttatttatgtcctttttctctcccccatcacttagcatttagccttactttagaagggtcctgtatttgctttaaccttgtaaagaactttgagtgcttattaaatggaaagccttgtgtgtgtgtgtgtgtgtgtgtgtgtgtgtgtgtctgtgcgtgtgtgtgtgtgtgtgtgtatttagagacagagtcacattctgtagcagcccaggctgaagtgcagtggcatgattttggctcactgcaacctctgcctcacaggttcaagggattctcctgcctcagcctcccaagtagctaggattacaggcacctgccaccatgcccagctacttttgtatttttagtagagacaggatttcatcatgttggccaggctggtcttgaactcctgaattcgggtgatccacccgccccagcctcccaaagtgctgggattacaggcatgagccatcacgcctggctcaaagctttgtatttttaaagatattagacatgtttcttgtttgtttgttttttttaaaaaaactaaacgctaatgtaggagaataagagaaagtttttccaaaaaagagaaaacattgtgattatcttattggaatgttggataataaagtctgctttatcaatcatcaagcacactataaaatttccattttaataggacttgtacctcaattgaggtaataaagttttaaagtttttaaagtgaaagccagccccgcccctctcctggagtgggcggggacagcggttgcataggcagctttccttgtgacaacacaggtccttcatgacacgctgctgtctggccacacctccttttcctttcatctttctcattgaccaatgggcttcaagcatgaaggccacacccctattctgcattctagtgcagccctggttacgcctcctctggctcagtcacacagcgacgtagaggtgactggaggtatatacttgtcctcacctggatcatgctgatgtggccccaaccccacctccctacccatccccacctccctacccatccccacctccctacccatccccacctccctacccatccccacctccctacccatcctatgatgtccaaagaaaccagacagagcaaattggccgaggccaaggaacaggtaaacgcaccaacaccccaacccaacccgaggccccctctgacagccgaactgctgccagagtctgtgccactcctgagggacaccaggctgggccccccaccccagtgcctctgggctccccacaccaaaatcttgtcagccagcccaaccccctcataagtcctgcccctgctctgcccggcacaccagggtgactttgagcaggtgactcctggggcttccaactccatactccgcccttacctcctgctaccccaaacccgacctccctgggctccttgagctcacatctccaaggacctgggtgccccagaacctgccctcaccagttgccacagggtgactttggggatgtgactcctggagctccttgctccttaattggccctcacctcctgccgccccaagcctgacctcccggggctctttggggtcacgtctccaaggacctggctcccaattttgtgaccccctccccagtctcaaagcggcaacttgggcattgcactcatgtgtcccccccaaccactccaccgaggagtagaatgtagtgatgtcacagtcccgctacaaactgtcattactaccacaagaccggcctttggtcttaggacccagtcccctaagtgttcttgcccacttctgtttcctctggttgcagcacaggtttccagctggaaggggaatggggactgtgggacctagaagagagaggtttcaggctgcctgacttccttaccacagaccttgacagtgtgaaaagcctacacctcccccatgagctcaacacgttgacagtgtctctgggtggcaatgggagaacgggtttggtttggttttctcccaggcttctactctccagagagattttaacattttttctcagttctgcacctcagatttgaattctccattgttctgggaccagagtgcccctcagtcactggttctggagtgagatctgcttatcttctgtggaacagatcttgggaaactgaacttagcttgagtcttcctcatctcatctcaacctggggtactttgagtgccacaggataaatatggggcatctttctgaagcatcagtttcccttgattctattgagaggcaaaacattaatgtacttagggatgaaagtcacgtagatttataagcgtatacaagacttctctctgaaatgaggcttgggttgtcctctttctgttaaattcccagatttagcagaaaggctgccttctgccatgaggagacattgatgtaaaggtttgagaggtactggtgtactttttaacactaacagacgtgtgagggtgaataaccctaaaccacatagtgcacagttcctgcctacttaatatttgcttttctacctctgcctctggttttggtccctggcagctgctgatttagggcaaaatcccagagctcagagtcagaagactgagtttaagttccattactgccttttttttcagccatggtatcaatctctctcagtcactaagtgattgtgacaacatttcctacagttggtggcattaaatcagatggtctataagagtatttagtataaactgtaaagcaggatgtgactgtaggagcttgtagttctcatgagtatcactgctcttcctttccacagttgacagaccatcatccccagaccaaccctagtgttggtacagcagcaagcgacaccaaaaagaagaaaataaataatggcactaaccctgagacaaccacttctggtggttgccactcgcctgaggatgtgagtcttggctggccgggctcctggggacagagggcccaaggggtggtggagggtaattgttaagattgtggaagaactgccaggtactggctaagaattctgggtttgaatcctacccctccatctgctagggacatgatttagcgcaaattgcttgagctctttgggcctctcttttcacatccgtaaaatacgagtggtattgttttccttacgtttgtgaagtttaaatgagatttgtcattgtgtttttatgttaatccctcgtccaggacctgctgtaaactctccttcttgggcttgcgtttcctgaggtagagttagagagtatcagaggtttctgttagctctgagagcccgagagttaaaggcccactagaatggaaacctcggggccaagggctcctgtctgccttttctgacctctattcccgctgtgaagaaccgtccctggcccgtatgtgctcaacgtttgctgagtgaatgcacctttctaaatcacaagctggcggaagggtgggcttttctcgcactccacctctgaaggtttctgttactgtcttttcaagagaatctagtttcagactttgagttctgtggctgtgggcaaaaaccaaaaagacccaaatccttcttctttgggagttgaggagagttgaccagttcatgttcccattgggtctgagaactgtgccttttaaatccattcctggcccctgcctatcgcttcctggcctggggaatagagtcaagggggccaccctcagtcaccttcctttgactctccccacagaaacaatagaaccgagctcagctggaagaagtagtgtgatttctttgctcacgacatgaccgctgggtttgggggcactcagatgtagaggccccaggctcatctcacccactcccagcctggggaagaaggctcacccccaagattccaccccatccccacagggtccctgataaactggtcccatgggtgggcctgttctggggcagtggtgccattctgggggcatgtctcttgctgtggatctctgcctccccctagtaagagctctgttttcctctttctataggaacagaaggcaagccaccaacatcaggaagccctaaggagggagctagaggtgagtggagggtgtgaagttccctcctgccctctggagaatgtttctttgcttctctttcagcatttgcttgtcttttctcccaaaggcccaggttcataccatacgaatccttacatgtcagaaaactgagcttcagatggcactctactacagccagcatgctgtcaagcagttggaaggtgggaatctggcaccccatcatccttcaacctggcactttgacaggcctttagggggagtcctttgggccacatctgaatgtctctcattccaggagaggccagggatctgatcagccgcctgcatgattcatggaagtttgcaggagagttagagcaggctctctctgctgtcgctacacagaagaagaaggcggatagggtgagtccaaacacggccccgtcccttgggagcccagcttcgcagatggaggagtgagcctaaaggtcccttctgtaggatggagtgtcctgcccagaaggcagcatggccatttcttgctgcttttgtgtgtggttgttagaggcagactggggctgagtcggctgttgtgggtgagttggggagcactgtgaggagcgagcactggacatagagctcagaggccaagtgcccgccctgcccatacttggctgtggccttggccaagtcctaagtggcggttagggtacttgtaccataaaggtacagaagagtatcttgagtatgttattatttgtgtggagagagggggcaggtgtatatgtgtgtgtgtgtacgtattatggtaacatacataaaacacgtttgtaaggattcattaaaaaactcaggatagaggcacagtgttggggggagatatttcccttctggactttctgagttttggactatgcgaacgtatcatcctttcaaaaattcaacaaaggattaatttcctccttcttaactgtgcccctacctccagcggaagaatgggcttagagaatcagatatagctgggtgttgaaatcccagctccaagtgatcttaggcagcacttaacctttaataccgcatgtttttcatctacacaatagaggtaataatggtaaccatctcctatggaggttgtgaggattaaatgggattgttagcatagtgcctggtgaagcactcaataaaggttcgaacagtggtagtactaacagtaatagcaataacaatattatctgatcgctctgggcccctgttagccagccctaaattcaatctctttccctgtcccttccacatccactgagttctttgaaaaacaaatgagggccaggtgctctcgctcacgcctgtaatgccagcactttgggaggctgaggtgggcggatcacctgcggtcaggagttcaagactagactgaccaacacgaagaaaccccgtctctactaaaaatacaaaattagcccggtgtggtggcacatgcctgtaatcccaactactcgggaagctgaggcaggagaattgcttgaacccaggaggtgtaggttgtggtgagctgagattgtgccattgcactccagtgagggcaacaagaatgaaactctgccaaaaaaaaaaaaaaaagaaagaaagaaagaaagaaaaacaaatgagaccatgggcttggaaatgccttgagaacacgtcaggtgtgattgagagtgaggaagtgttactgtggagtagtcactgtagcagttgttcctggtcgtccagctactgctgtgcctgctctatcctgacttaacctttctctatttgcagtacattgaggagttaacaaaggagagggacgccctgagtctggaactgtacaggaacacgtaggatgggggaaggtggaatgggaggtctgggggcccttagcatgggtggtgtgctgggaggtggggggtccaggtgagtgtggggagaggctcatacatgttttcatgtgtgcacacggaagctctagtgctggctgtgccactgactcatggggtagcctcaggcaactcatgtcttctctctggcctgccacctgggacttttaattcctggggtcccttccagcgccacggttctgtggttgtggggcgagggtagggggtcaatcaccaaagtggtcttttatgttcttcattcattcctttctctactgcctctggccatagcataactgatgaggagctgaaggagaaaaatgccaaactacaagaaaaacttcaacttgtagaatctgaaaagtctgagatccagctcaacgtaaaggagctaaaaaggaaactggagagggccaagctcctgctgccacaggtgagcagctgcagccccgggggttgtgggagacccatccagctgggaccatggtctagggatcatgcagggtatggggaggctccagccaagagctggaaaatttgggtccttgttctggtcccgccatagaatcctctagagtgtactaaaaatgtacaaattggggccctgcctggggaatcagaatctcaagagttagggcttaaaaatatttttttaaaggatcatggatgaaaaccattattttatagattacatttatttatttatttatttatttatttatttatttgagaagtagtctcactctgtcacccaggccagagtgcagtggcgcaatctcggctcactgcaagctccaccccccggcttcacgccattctcctgcctcagcctcccaagtagctgggactacaggtgcccaccaccacacccggctaattttttgtatttttagtagagacggggtttcactgtgttaaccaggatggtctcgatctcctgacctcgtgatccgcccacctcggcctcccaaagtgctgggattacaggcgtgagccacggctcccagcctatagattacatttatgtggctagctcatgattctgcttccttctgaggttcaaaaaaaaacactttcactattccagcagcagctgcaggcggaggctgaccacctgggtaaggagctgcagagtgtgtcagcaaagctccaagcccaggtggaagagaacgagttgtggaaccgcctgaaccagcaacaggaggagaagatgtggaggcaggaggagaagatacaggagtgggaggagaagatacaggagcaggaggagaagatacgggagcaggaggagaagatacgggagcaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatgcggaggcaggaggagatgatgtgggagaaggaggagaagatacgggagctggaagagaagatgcacgagcaggagaagatacgggagcaggaagagaagaggcaggaggaggagaagatacgcgagcaggagaagaggcaggagcaggaggcgaagatgtggaggcaggaggagaagatacgggagcaggaagagaagatacgggagcaggaggaaaagatgtggaggcaggaggagaagattcacgagcaggagaagatacgggaggaggagaagaggcaggagcaggaggagatgtggaggcaggaggagaagataagggagcaggaggagatatggaggcaaaaggagaagatacacgagcaggaggagaagatacggaagcaggaggagaagatgtggaggcaggaggagaagatgcacgaccaggaggagaagatacgggagcaggaggagaaggtgtggaggcaggaggagaagatacgggagcaggaggagaagatacgggagcaggaggagaagatacgagagcaggaggagatgacgcaggaacaggaagagaagatgggggagcaggaggagaagatgtgtgagcaggaagagaagatgcaagaacaggaggagaagatgcggaggcaggaggagaagatacgggagcaggagaagaagatacgggagcaggaggagaagatacgagagcaggaggagatgatgcaggaacaggaagagaagatgtgggagcaggaggagaagatgtgtgagcaggaagagaagatgcaagaacaggaggagaagatgcggaggcaggaggagaagatgtgggagcaggaagtgaggctgcggcagcaggaggagaagatgcaggaacaccaggtgaggctgcaggagctggaggagaggctggggaagctggggcagaaggccgagctcttggggggagcaggcggaggtgtgtgcaaaccctggagatcatacagaatgacctcaccacaacttagcagatggtggttggctccctctgcttttccaccagtctgtggcctacagtttaaatggtgggaagaagggtgtgagatttgaggctggggagggaggcatgggcctctaggcaagggaggcagtcatttaggcctggaggaaggggccagggccaggggcctgggtaggcgacagagccccgcagtgccctcactaccctgtttatgggcccagaatctggaagccagccactacctaccctgacgcctatcctgcaggtggagctgaagagccaagaggctgagtctgcagcagcagcgagaccattacctgggtcacctgcagcagtacgtggccgcctatcagcagctggcctctgagaaggaggcactgcccagctgcagcagcaggaagctcagggcgaagcggtggccgagatggcccaccaatagttgcaggagacccggttgagggagttgatgagggcggggccccaagggggatgatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccactctttacaaaaaaaacaaaaattaggcgggcgatggtggtacccacctgtggtcccagctattgagagggttgaggtgggagcatcatgtgagttggggaagttgaggcccacagtgagctaagatggggcccctgcactccaccttgggcaacagagcgagaccctgtctgaaaataaaaaaaaataaaaaacggggttgagagacaaaaaaggacatccttttttttattattatattttgagatggagtttcgctcgttgcccaggctggagtgcaatcgtgtgatcttggctcactgcaacctccgcctcccaggttcaagtgattgtcgtgcctcaggctcctgagttgtaaaacgacgaccagtagacctgcagatctgatatcatcgccactgtggtggaattcagacggggtttcaccatgttggtctggtctcgaactcctgacgtcaggtgatccacctgcgttgccctcccaaaatgctgggactacagacatgagccaccgtgccagccgaaaccttcattttaaaaaaggctgggtcaggcatcatgcctcatgcctgtaatcccagcactttgagagggcaacgcaggcggatcacctgacgtcaggagttcgagaccagaccaacatggtgaaaccccgtctctaccaaaaatataaaaattaggcgggtgtggtggcacacacctgtaatcccagctactcaggaggctgaggcaggagaattgcttgaatctgggaggtggaggttgcagtgagctgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggagcggccaagttggtccctgagcagtgactttataataacatgttacactgtgttttttgtttttgtttggttttttgtttgtttgagacggagtttcgctcttgttgcccaggctggagtacaatggcgtgatctcagctcaaaacaacctctacctcccagattcaagctattctcctgcctcagcctccaaagtagctgggatttcagtcatgcaacaccatgcccggctaattttgtacttttagtagggatggggtttctccatgttggtcaggctggtctcgaactcctgacctcaagtgatctgcccgcctcggcctcccaaaatgctgggattacaggcgtgagccaccacacccggcctatattttttttctttttttttagacacagtctgactctattgcccaggctggagtgcagtagcacgatcttggttcactgtaacttctgcctccctggttcaagcgattctcctgcctcagcctcccaagtagctgggattacaggcatgcaccaccacatccgactaatttttgtatttttagtagagatggggtttcaccatgttggccaggctggtctcaaactcctcacctcaagtaatccgcccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataatttttttttttttgagacaggatctctgttacccaggctggagtgcagtggcaccaccttggttcactgcagacttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaattaatactttgggatgccaaggcaggtggatcacgaggtcaggagttcaagaactgcctggccaagatggtgaaaccccgtctctactaaaaatacaaaaatttgccgggcttggtggcaggtgcctgtaatcccagctattcaggaggctgaggcaggagaattgcttgaacctgggtggcagaggttgcagtgagccaagatagcaccactgcactccagcctgggcaataagagtcagactctgtctaaaaaaaaaaaaaaattgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttacaataaatcatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggcttagtcctgaggtgggtctgactcaggtcagggctgtgcaccccggccctcctcctcaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagatctggagccccaaagatcctgaccaggggcctgcctcctccagggaggggccactcgcccccaccaagctcccttcacagagacccatccaacagagctgaggaaaaccatgcctcataaatgaataaatacataaataaggatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccggccatgcagtggttttcagtgcccgaaacagatgaataaaataggccctttactggatgttcttcaggaacatgcgcacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttccactaaagctatatctatgcctaccttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagagtagtttcctttgtgggaaagtgtaggtcaggaaggagccttctggggtactacaaatctgccgtattttggctgggtgcaacagctcacaccagcacttcgggaggcataggcaagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacaatttactactctctttcttttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattacactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcgcggtggctcgtgcctataatcccagcatgttgggaggccgaggcaggtggatcacctgaggtcaggagtttgagaccagcctggctaacatggtgaaaccccgtttctactaaaaatacaaaaaattagtcaagcttggtggcgtgcgcctgtaatcccagctactcaggaggctaaggcaggagaatcacttgaacctgggaggcagagattgcagagagctgagattgcaccaatgcactccagcctgggtgacagagtgagactccggctcaaaaaaaaaaaaaaaaatttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattgctgatttagacctatcttttttgtaatatataatgatttgatgctataaattttcctctaagcagtgctttaattaaacccacaaattttggtgcattttcatttatgttcaaaatattttctcatttctttggagaattgttctttgacccatggatgatgatgatgatgatgattattattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgtggttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccgaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcatgcgactgcactccagcctgggcgacagagctagactccatctcaaaaaaataaaatttaaaaaaagtatatgtaaagtatatgtatggccgggcacggtggctcacgcctgtaatcccagcactttgggaggccaaggcaggtggatcacgaggtcaggagatcaagaccatcctggctgacatggtgaaaccccatctctactaaaaataaaaattaaaaaaataataataattagccaggcgtggtggtgagcacctgtagtcccagctactcaggaggctgaggtaggagaatggcgtgaacccaggaggcagagcttgcagtgggctgagatcgtgccactgcactctagcctgggcgacagagcgagactctgtctcaaaaaaaaaaaagtatatgtattttgctgttgttgggtgaagtgttccataaattagatccagtttattgaaggtgttctacagttctcctagatttttgccgattacttgttctctcactatgaaagatattgtgtgtgttatatgtgtctaacaattcattgtctagttagagttgctattataccacttcaagtggatggagagcctccctgccatccattaatgtgcattaatcattttgagagtgaaaagattttttaaaatgtttttactcttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccgcggactggcccccgccccaggagaaagagtgcgtggccgtggcaacgctgaatcttccccgacttcaggtattcgtgatttcccttcctcttgctccttttataagtgtcttagcgatttgtaagaaggtttatgtattttgaaggacataggttttagcctgttgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttgttgcgtgtggagaaatgactgggtgagatcacaggtgatggagagagacagcgctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaagaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcaaaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatatctgtggcatcctggcgtttgcgtggttgcgccccaggtgtttgctgcccctcctggtttgcggtgatgtgtctgttctggtcagtgctgtggggcgtggccttgcgtatgtcttaggctgtcgaggtgtcccagcgtatggttttgcatttgcctctccggggtcctgaaggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccagagcctgggacgggcagtgtgttgccccctggctgcggttggctggcaggcaggtgatcctgagtggctcccagccttctgcaggaagctcgggttcagtgggtccttgtgtgcattcccgtgtgggaggttgtgctgaagcctggcggcttggctctgctttcagagcccggaacctcttgactcctgctgtgtgtgcccacgtgaattttggttttgcacttgaggagtttccctgtgtactctcagctccgcagtctaatttttagcagctctttttttttttttagacagggtgtcactttgtcacccaggctggaatgcagtggtacagtcttggcctgccaggttcaagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggatgacaggcatgagccaccgcctgtggcagcttttgtggttacattgtagccattatttctgtgtttggtgcagattgttggggcggggtggaggttgctgttgctagttgtttagctcttctgctcatcttgagcttttccatatatgtgttcatagtggggttaaaaaaaattcctctagaaaatacttcaactattgtgggtaagagtttttttagtccagtttttaaaaatacgtaaactgagaagttattttgtctatttagataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgcggaggtgggctcggggaaggaacaggagagggcatgggtcagggtgctgggaggggatggcgtttcactcaaattggcacacactttctatttcagtttcaggcaatgaagtgagcataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatcgctgtgctccttggcacttgcagccaggatactcccctgccctgagattagattcatttttcctgctctgagtgtcgcagcaatataactgtatagtatgcactctttcctgctttgccttggagaatgattttcagattcgctcactgttgtgtgtattgcgacttcgtttttattattgggaagttttccattttataggtgtagtactgtttgttagttcattctcctattgaaggacatgtaattgtttttggtttttgttttctttttttttttttttttgagacagggtcttgctctgtcacccaggctgtatacagtgacctgatgttggctcactgcagccttgtactcctaggctcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggttagtgtgtgttcatagtttcccaaagtggctttgccatttgcatttgaaccaggacttgtgtgtgagaattctagctccttcttgtccttacagagcagctggatgctgcgtgtgtggagccgatcacattgggttttgtgtgagccattagcagggttaaggattttagggacttcacagaaggaggctggagagcatcagcagaggcagcctagaccttggatctgtaaaaagaagacactgtttgaaactgcacaaatgagttggggtttccaacagggcaggtgggggcctgtgggtggatgggtgtggcagccacagaggctgggatagcttggcactggggtcagggctcagccagcctgtgtgccttcacacctggtaatgagatcacttgtaaacaatttctgtttatcaattacaggatacaaaaaaagaagcacggaaggaaaaagaaatttatgaacaggaagcaaatgcctcaacatttcatagaaggaggactccattggataaaggccttattaatacggggatctgtgagtcttctggcaaacagtgtttgcctctggttcagctcatacaacagcttcttaggtaaatcatattagctgtattgtattgtgttttatttatttacttttttgttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttgttagagacagggtttcttcatgttggtcaggccggtcttgaactcccgacctcaggtggtccatccactttggcctcccaaaatgttgggattacaggcattagccaccacgcctggcctatttatttacttattaatggtgttttttttttgttttttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttttgtatttttagtagagatggggttttaccatattggtcaggctggtctcaaattcctgacgtcaggtgacccacctgccttggcctctcaaaatgttgggattacaggtgttagccactgtgcctggcctgtattgtattttaataggtgattattggttttcatattaagatagtgaaatctagcgcaaggatctcaaaaatttgtttgatgattgaaggaatattctgaaaattacctagtatagatgttaggataaagagcagacccttttcaatataggtgagaggagaagttggagggtgtgatgatactcaaaagtttttcactgaagagaaattggggcgtgcagtaaacatgtaaaaagattcttactaataagcaggtggatgcaaatgaaaatcatcatggaaggttatttttaaaactggttctatcattgcctcactttatatattacagagttatacatactactttgtaagataacttttcttttcaaaactgaagtcaatgtgatagaatggtgagcattattttggaaggccagactaggaggaggtgggaggaagaagtcagactcagcctgtgaacagacgctaaccttggcagaagccaaaacagtcagacagtgttgtctaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagcttgggtcaggcagccgagtacagaccagggagccctgggcagtggctgcagctctcagctggcctgttcatggggccatggtgggtctgtggcgtggggtgggcctgtggcgtggggtgggcccgcggcgtggggtgggcctgcggcatggggtgggcccgcggcatggggtgggcctgctgtccacagccagaaaaactaacttagtgcacacacagtgaaattttgaaacaggaagttttagagctagtttctgtcatagattttagtaaatgctattttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactatgggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagactggagtgcagtggtgcaatcttggctcactgcaacctccgcctcttgtgttcaagtgattctcctgcctcagcctcctgagcagctgggactacaggactacagactcccgagcagctggcactaccaccacgcctggctgatttttgtatttttgtagagacagagtttcaccatgttggccaggctggtctcggactcctgacctcaagtaatctgcccgctttggcttcccagagtgctgggattacaggcatgagccactgcaaccagccattattacaattaattttatgtgttgttgtttttcttcttggtgtttttttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctgatttttgtatttttagtagagatggggtttcaccatgttggccaggatggtcttgaactcccaacctcaggtaatctgcccacctcagcctcccaaagtgttgggattacaggcgtgagccaccgcacctggccatgtttattaatacgactaagaacattttgaattgcacctgtggctccattggtgtcctgggcaggtggctctgtgctgtccacacaggttgtctcctgtgtcttcgtcttcgctgcgtgtgactttttggttcctgtggcacgtggggtcctgtatgggacattggttctacagcagatttatagtaaggatgtacctactaaaaaatacaaaataaaaagaatagacacaaacatagaaataagtatcacctcacaaaacttttggaaagtagaaaaagaaaaatgcattcgcagctttccagtagccgatatccaggctgtcttcatcagcatggatcatgtgtccctctcctgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgggttggagaaatcgctgcttgccaaaaataagccgtgaaatgtatttcagagtagatcgttatttacatgctggcgaggagccacagaataccatttacatttgaaaatagagcgctgcgaagtttttataagtagtgaatcccatcagaattacacattttgattatggctctaaattttatattaaataaactaaaaatttcattgtattgtattaccgtctcttgctccttcaggtgtagcatacatgctagattctagacctgtttcttgtgttacagtggtgttatccaggcagggtatcatgtagtgaaggtgatgtcgagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagacacgggggcaagtgggattgacaagcctgctgtcacattaggaacctgagttaaagtggagctgaaagcatgtcctcgctcttgatgttgtgcagagagccacctgtgctcctggctcaacggggcgggtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatgccagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcatgttcctaaaagcctctttgggctgagggaaggcatgggtggctctgccagttttggagtgggggccgactcttctcagagccgctgcaagggccagggccaccctcccaggcgggtgtctctgggctgggcagcagctttgtaggcagcctgggtcatccccactggcctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgttttgagctttgggggtggatctcccaggaaacgtgtttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttccgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatctcaccttcccttcctcagttaaggacacacaccgcagttgaaaatcactgtgcctttccagatgcagaatctgacctttccgataagattctgttaactgctgctttctgcagtttgtattccaaaacaaggggaatatgtttccattttttcaatacaaatgtttaagtcggatatgctttctcaaactggacacgcactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggccccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccagcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggccggacaggcccaaaggtgagcaacgtgagcacatcaggtgggctcagagctggcgcatgagccccacagcctgcagagcagccctgtactcgggagcccgctcgcaccaacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacgtccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacagtctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctcccttcaggaggccacatgtaagctggctattgaatgtggctctgagctgagacctctccttgaagctccagaccaggagccagctgatagctggacccctccatttggtgcctcagagaaactttgcactctctaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctagtccagtttgctgtagaaagaccagtctgccactgtatggcacatggatggcaggggcagagtgcaggtggagagaacagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagaggtatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggcagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcagagactctgctcagctgagtctccagcacgaccatgagcttctcatcctgatcctcccatccccaccctacttttctcccccagcttgctcaacaggtgaccttacaggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacgtgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctgccttctgacacaccagcctctgtctctagcacggtggcccccacacacccagcctgtgaaacctacagccctcaagaaggctttggccaaattaaggagcggctccctctcccaggaggaagcacaggtgaaggatgtggagggcagtagagttgtgtgtgctccgccccctttctccacagtcggatggaaagaagggggctttcagccaggctcgcccaggctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgacatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcagtaaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggaaggagatgggaccttggtggggaccctggaagggccacccctgggagtccaaatgaataaaacatagaccagccatcagaaaacctaaaacctgctttgaaccagcttagtcccaaagtagatgaaggcgatctgcccttactccaattgtgtgccataaactcaaagtcaatactctctggaggcagataaaagtttactatgaatgtcaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactattggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcattctgtatgatctccagggtttgcacacacctccgcctgctccccccaagagctcggccttctgccccagcttccccagcctctcctccagctcctgcagcctcacctggtgttcctgcatcttctcctcctgctgccgcagcctcacttcctgctcccacatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccatatcttctcctcctgctctcgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctcctgctcccgtatcttctcctcctgctcccttatcttctcctcctgcctccacatcttctcctcctgctcccgtatcttctcctcctggtcgtgcatcttctcctcctgcctccacaccttctcctcctgcttccgtatcttctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctccagcctccgcatcttctcctccttctcccacatcatctcctcctgcctccgcatcttctcctccttctcccacatcatctcctcctgcctccgcatcttctcctcctgctcccgtatcttctcctcctgctcccgtatcttctcctcctgctcctgtatcttctcctcccactcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggagcggtggctcacgcctgtaatcccagcactttgggaggccgaggtgggcggatcacgaggtcaggagatcgagaccatcctggttaacacagtgaaaccccgtctctactaaaaatacaaaaaaattagccgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaatgtaatctataaaataatggttttcatccatgatcctttaaaaaaatatttttaagccctaactcttgagattctgattccccaggcagggccccaatttgtacatttttagtacactctagaggattctatggcgggaccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagccactccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttctttttttttttttttttggcagagtttcattcttgttgccctcactggagtgcaatggcacaatctcagctcaccacaacctacacctcctgggttcaagcaattctcctgcctcagcttcccgagtagttgggattacaggcatgtgccaccacaccgggctaattttgtatttttagtagagacggggtttcttcgtgttggtcagtctagtcttgaactcctgaccgcaggtgatccgcccacctcagcctcccaaagtgctggcattacaggcgtgagcgagagcacctggccctcatttgtttttcaaagaactcagtggatgtggaagggacagggaaagagattgaatttagagctggctaacaggggcccagagcgatcagataatattgttattgttattactgttagtactaccattgttcgaacctttcttgagtgcttcaccaggcactatgctaacaatcccatttaatcctcacaacctccataggagacggttaccattattacctctattgtgtagatgaaaaacatgcggtattaaaggttaagtgctgcctaagatcacttggagctgggatttcaacacccaggtatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagctctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattccagccacttaggaggctgaggcatgagaatggcttgaacctgggaggtggaggttgcagtgagctgagatactgctactgtactccaacctgggcaacagagtgagactctgtctcaaaaaaaaaaaaaaaaaaaaaaaaaggaattgtcatcaaagtcctacggctaaacccttttcctttttttttaataactagtattactagtcttttccaagaaccaaagttaaaagttagttctttaaaacaccaggccaggcacagtggctcatacatgtaatcacagcactttgggaggccaaggcaggaggatcacttgaatgcaggtgttctagaccagcccggacaacaaagaaagaccctgcctctacaaaaaaaaatttttttgctgcaaaatgctctcaattaacctgacaaaatgtcacatacagggttactacatcttttttatcatggaattttgaaaacaaaaattgttctattgaggcaccagtatttggatattagaggtaaaaaccacccttagaatccagtcctaaaaacgtcaatgaagactcccatgtttacaaattcttttatttctacatgtcatctatcaactggattatgaacctgaaagcctgagaacagaatttatcaagatactcatgtttatactttttttatctactgatcgtttttattttttttgagacggattctcgctctctcaccaggctgtagtgcagtggcgcgatctcggctcactacaacctccgcctcctgggttcaagcgattctcctgcctcagcctcctgagtagctgggactacaggcacgtgccaccacacccagctaatttttgtatttttagtagagatggggtttcaccatgttggccaggatgacctcgatctcctgacctcagcctcccaaactgctaggattacaggctgagccaccacacccagccatgtagccatctactgatatttctaagcatgaagtgacaatttttttttttgagatggagtcttgctgtgttggccaggctggagtgcaatggcatgatctcggctcactgcaacctccacctcctgggttcaagcacttctcctgcctcaacctcccaagtagctgggattacaagcgcacactaccacgcctgactcttttgtatttttagtagagacagggtttcaccatgggcgccaggctggttttgaactcctgacctcaagtgatccgccctcctcggcctcccaaagtgctgtgattacaggcgtgagccaccgcgcccagccgaagtgacaatatttatatacaataagcttaactctaagagcttacatttatgcgtagtcattcttaattgatgattagaggaagagacaaataaatggtcccagtttagctactgatatactcaacaaaccttgacggacctgagggcattatgctgagtaaagaaaatcatttccgaaggtcacatatcacttggtaatctcacagtaacaaaattatagagatggagaacagattagtggttgtcaggagttagagatggtggcagaagagaggcaggagagacatctttgtagtgatgaaacagttctgcataggaaattgtagtagtagttacatttacagacccttgatagaatggcacagaactacgcacacacattgtaccaacttcaatttctgggtttttatactctattataattacataaaatgtaaccactggggcagtatgcgcaaatacacagtgacctctctagtttctttacaacttcctgagagtctattattatttcaaaataaaaagttttttaaaaaattgcttcatgcctatctaatttcatgtgccacttaaaaaagaacacaaaaatagaaactgtaggaaattcatctgagtgcagcttatgcaagaaggggcaggataactccattctggacttatgctcaaagacatgcgcctttaccttacaacaaaactggcgaacaggcatgtgttttaagaataaaaagcttttaaggtatcatatattgttttttatagttcctttgcttaactgacgttttggtttgctaaaaaactaccaatcacatcagattacaagtactttcactgtaaaaataaaaagtgatgtgactgacacctcttagctctgtaacgtattactctttacgagagcagtgaaggaaaacatggtgattcaatcactccacacaccaagcagaaaagtgttgaacaggccgggcgcggtggctcacgcctataatcccagcacttccggaggccgagacgggtggatcacttgaggtcaggagttcaaaaccaacctggcccacatggtggagccctgtctctactaaaagtacacaaaattagccaggcgtggtggtggacacccgtagtcccagctactcgggaggctgaggcaggagaatggcatgaacccaggaggcttgcagtgagccaagatggcaccactgcactccagcctgggagacagagtcagactccatctcaaaaaaaaaaaagtattgtacaattaaactgtttatatgtaataaccacatatatatgcctggcataaaatgagccctgcattagaggttgctggatgtagggccctaggcctgacgtatccaaataatgtctatgataaagaagtcaataagtgctctctataacacacaagcattataagttttcacactccaaaaactcttcctttctaaagttactaaaacttttaagggcatttcaaacaaaaacagctgtggaaaacagatcggttaaatcctatggctaagaaacatcttcctatcccatgtattattcattacccaggtgtcaattctgtttccaatacaaaagtctcaagcagtgaagcgcttcccactccagctgggagagccatcctcaacaagataagggtaaaacctgtgagcacaaggcttccatctgcaattcctgtctgcagggaagctccccaaagagggaaaccatgtcttattccttacggtaaaacaccaccattcattccttgtgtttaacaaccaatgctggtggaacataaaacaaagcttagcaatcacttttttcatgctacttagacctgtaacacatttttcctctggtgcacactatccaaaacctagtcatttcccttactcctaggaggaatttagatgactttttttttggccaggtgcagtggctcacgcctgtaatcccagcaatttgggaggccgaggcaggcagatcgctttgaggtcaggagaccagccaggccaacacagtgaaaccccatctctactaaaaatacaaaaattagtcgggcatgcatggtggcacacacttgtaatcccagctactcggaaggctgaggcgggagaatcacttgcattcgggaggcggaagttgcagtgagccaagattgcgccactgcacgccagcctgggcgacagagcaagactccgtctcaaaaaaaaaaaaaaaaaaaaaaagactttctaatcatattggaaatgtgtaacaaggaccaagtactgtgtattaaacttaataaatcaaaacaacaggccctctaagatataaatggtgcttcactgtatgtttatctgcccaacccatcataggaactcaattcagcattaaactggttttagatcaagacactagaactcatgtttagcagttattaaattacaattattaagaaaaacactttattacgtaaagtcctttactccaaaaagtttctcaaaatacataaacactaatataaaacaattattaaaactttgcctgaatctcaggatttcagaaatatgaaagtactcatctctcacctctcccatccacttaaaatgacaaaacagatcattatagctaaatcaaaggaaatgtttaaagagaaacaaacccaaagagtaactacaccaattcttgacccaattctctgtactctgtcttatgtaacattacactatgaataacaatcccatcatccacaacagcttttttttttttgaaacagttttgctctcattgtccaggctggagtgcaatggcatgatcttgacccattgcaacctccacctcccgggttcaagcgattctcctgcctcagcctcccgagtggctgggattacaggcatacaccaccacgcctggctaattttgtatttttagtagagacggggtttcaccatgttggtcaggctggtctccaactcctgacctcagggcatccacccgcctcggcctcccaaactgccgggattacaggcgtgagccactgcgcccggccacgcaacacagctctaaacactggactctcatatctaccaacactcaatacctgtttaaaaagaaaaaaaaaattaggaaggggcaataacacttcagtgtaagtatccatgatcaactactgcttaacagcctacacgacttttgatgaacagtcaaggcacattacttaatacttaaaatggttaaccttagggagtaggaaaatacagacacacacaaaatatttcaaacacttctttttgctgctgataaggagttccaaaagtagtttttccaagccatttccaaataaaagtagattgggtgtaaataattgtctatcgaaatattagttattatttatttaataatgtcctgacaagcttgcagttatctcattaaatcaaaaaattaggatctaaggccaacattgtttcctcacattcttgatgtgaaaatctgagcactcctcttaataaggagttacaaagacaaaacaaacagctcaactgaactaactcttgtctctccagaaacacaaacacaagacctcataaaatgagtgagtttctataggccataattactgcaacttacttctccaattttcccctccacagttaactcaacagctcaaaaacgatcagtaacaaacaacagtcaccatgatatggttaggagtgtggcagatttcttaaccagtaataataaataggaaaaaaattttgcctattaatagatctcaagtttcgtgcacttgcaagaaactaattaaaaggcagccgcgcacgatctacaaaaacagccataaagactgttacattttaagttacaggaaataaacctgctcctctaattcagcaagatacaactgacttccccttacataccctaaaaaaaagccttacacgagaaatttaaacatggaagcagaaacacaccaagaaaaagacatgtcaaaccccacctgtatatctgttttcaaccatttggagtcgaggcgagcctgggcagccaaacagaaagattcagagggcatcttttctccagcttcctcccaggtctcaggcctgcaagtaaacacatacgctgaagacctaacgctttttaatagtttacaaagacactcccgaaagccagaaaagaaaaaagagagagagaacagaaaggggggagagaagagctggtggaggggagagaaagggagagagggaaagagggaagagatggagggagagggaggtggggaagggaaagcctccttccaaggtaggcagggtgtgccgagtttctgcaccacgctgacgagaccttgagaatggacggtcacaggaagccaagtcacaatgtcatccccctgccctcaaatccaagaagtacacacacataacagggagcccatcgttttaacgacaaatgacagcagcatgaatctgccgctttaccccacagcagggcgcgtgcgtgaaacaaaaaattactcaaaaggatcgcctgcagaaaaacccacagccaccaccacttaagagatggagagaggcccgaggctgccccgcgggtggtccgcgcaggccccggtgcggccgccgcgcccacgcccgcctcccgggctcggccgcccgccagccccgcgcccgtaccgcccccgccaccggccgcccaggtgccccaggccaggacctgacgcgcagggcccggccgcctcgcctcgccggcgcgcggacgcagcctcccaagagccgctggctcagccggcgcccgcgatcccggcgcctctcgcggcccgaggggcgggccgacgcgggactgccgccccccgcgtacggccaatcgcaacgaggctgctccgtgggcgcagccaatggggaagaggagcccttcgccgctcctcccgactctcccgcttccagcaatcccgcttatcttcctacttggagcgccctggctgcggccaaggccaacagcgggcgccggaaggcgggatttccgccgcacgcacgcactcccgcactcccacgggagactgcttggcccggagcgctcttgatcacgccgcggcgggtggtggcgctcacactaactatagctatccagggcgcgggtcgagtggcgagaccagctcccctgggtatgagaacgcatctttgtgcggtcggctggctggggcctgaagagcttcctcctgtgtgttcaactgaacgcagcaaaagtcttgggcagattccatggagcagctgtggaagcactgtgcagggaatcgaagaaggaaacacctccagcgaccacaaaacaaaattgaagaactataaaacaatataggccgggcgtggtggctcacgtatgtaattctcagcgctttgggaggccgaagcgggaggatccctcgaagccaggagttggaggatcccatgttgccagactgggcaacatagcaagaccccatctctaaaaaataaaaataaaaaaatttaacaattagccaggtgtggtggcacacacctgtgatcccagctgctcgggaggctgagacaggagaatcgcctgagcctgggagatcaatgctacagtgagcttagatcgtgccactgcactccagcctgggcgacagagtgagatcctgcctctaagaaagaaaaataacggccgggcgtggtggctcaggcctgtaatcccagcactttgggaggccagagcaggtggatcatctgaggtcaggagttcaaaaccagcctggccaacatgatgagaccccttctctactgaaaatacaaagattagccaggtgtggtggcacgtgactgtaatcccagctactcgggaggccgaggcaggagaatcgcttgaacccgggaggcggaggttgcagtgagccgacattgcaccactgcactccagcctgggggacagaggctgcaccactgcagccttgacttaccgggttcaggtggttctccacctcagccttgccactagctgggactgcaggcacatggaaccacacctggctaatttttgtagtttttgtagacgggattttgccatgttgcccaggctggtctcgaactcctgggctcaagtgatccgcccgcctcagtctcccaaagtgctaggattacaggtgtgagtcactgcactcggctaatagtaatgaactttgaacagaaggaaagttgttattattttcttggttatgttctatctatattttctaatttttctaaacatgtaaagataaaattctaaaaactcagacctcagaacaaaaaaattagagtataaatatttattttagttaacttgtacaaatttggtttctggaaaaagaatggaatagattttctgagaaaaaaaatccaccactttggccgggcgcagtggtttacgcgtgtaatgcctgcactttgggaggctgaggcggtggatcacctgaggtgaggagttcaagaccagcctgaccgacatgaagaaacccctgtctctactaaaaatacaaaaattagtcaggcctggtggcacgcacctgtaatcccagctactcaggaggctgaggctggagaatcgcttgaacccaggaggcagaggttgcagtgagctgagatcgcaccatagcgctccagcctgggtgacaaaaggaaaactctgtctcaaaaagaaagaaagaaaagcagactggctgaaaggattgaagaacaaaatatgatccaccaatgtgctatctacaagataaacattttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacttgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgagatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttggtacagacggggtttcaccatgttggccagggtggtctccaactactgacctcaggtgatccacctgccttggcctcccaaaatgctgggactacagacgtgagccaccgcgccagccgaaaccttcattttaaaaaaggctgggtcaggcatcatgcctcatgcctgtaatcccagcactttgagagggcaacgcaggcggatcacctgacgtcaggagttggagaccacactggccaacatggtgaaaccccgtctgtaccaaaatacaaaaattagctgggcgtgatggcaggcacatgtaatgccagctactcgggagcctgaggcacgacaatcacttgaacccgggaggcggaggttgcagtgagccaagatcacacgattgcactccagcctgggcaacgagcgaaactccatctcaaaatacaataataaaaaaaaggatgtccttttttgtctctcaaccccgttttttatttttttttattttcagacagaattccaccacagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtgaggaacattgaagtttctgagatattccttaaggaccaagctataattcacagctatctatttacatcagatctcagctttttttttttttttttttttttttttttgaggagggtgcaggaggagatgtgcgcagaacatatatatacggcttgccctaaaggatgaaataaaattgtgtatgctatgacctctctaggaagcctctaaacttttcttataaattgtcttctaactaaaatatttcttttggccgtccttggagtactcccaggtgacacacagctcgggctaacatttctacaggactgctaccttgatctctagagagtccaatgatgttccataccaatatgtctcagcgtcactgccgagcttccacccacacccttaacacacagagaaagctgacactttctgttagctataattttccttgagaaaaacgtggcaatatgtagcaaaatacaattattagtttcaatatgtagaacgtattacaagaaaaaaaagatgccaaaaacatcttatgtctactgctattcctattagtctttattatcatgaaaaactggtcgcatcctaaatatccaactttcggtgactgggtgaaggaaaactgtaatttttccatatgatagaatagtatgccagcactaacaaccagatagcagactatttaatgtcatggtaaagtatttgttttgtgtggtcaggtgagcagttcagatcataaaatcaaatgtaccctatgatcttattttttgaagtaaagtactgatgtatttatatgtataattaagtatagagaaaagcctagatggcttctcttataagtcttttcattgttttataaatggtatcaatatttatttttcactttttccatcagatttcctagaataataaaattcaattccctctgatgagcattcattattcttttttttttttttttttttgagacggagtctcactctgtctgctagagctagagtgcagtggcctgatctcagctcactgcagcctccgcctcctgggtcattattcttacagtaagaaaaaatgaatgttactaagtatcttctctgtcctagatcaactaggtatatacaaggtgccaaatacatttaataaaatgttttattcattcatagctttttgcagtacaattttttttgtatgattcccttgtcctatcatctccaccaatagttttggtgtgaatttatactctaaaggaaaggtgacaaccttatacaatctcagggcttaaatactatccacgtgctgatgcttacaaacatacacctccagttgtgtggtctccctgagttctgcacatccctcttgggcatctaacaagcatctcacagttaacaaaaccactgatttctaatcaatcccagggaccctccgccaggcctgctcctctctcagaattccttttctcacttagtgacactatcatcccaccaaacctcgctatcatctttcttccgtctcccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaatattcaatggaaacttgaaaacatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgagtagctgggactgcaggcacccaccaccacgcccagctaattttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggctgaggcaggagaatggcgtgaacccgggaggcggagcttgctgtgagccgagatcgcgccactgcagtccagcttgggccacagagggagactccgtctcaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattggtggagttgtctggaaggcaaggctcagatgggaaggactcttagttatagtgcctgcacagggtaaactttttttttttcttttttttttgagacggagtctcactgtcccccaggctggagtggtgtggcccgatctcggctaactgcaagctccgcctcccgggttcacgccattctcctgcctcagcctcccgagtagctgggactacaggcgcccaccaccaggcccggctatttttttgtatttttagtagagacggggtttcaccgtgttagccaggatggtctcgatctcctgacctcgtgatccacccgcctcggcctcccaaagtgctgggattacaggcgtgagccacagctcccggccaagaaggctctcttaaaaggaatcacttcttgttttcttacaagttataacctcactaccctagagtcacatttttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcacagtaaatgagtgaatttagaaattaaattttaatatgaaaggttcatgttgtcaaaactgactatgttagtccatctcaatgctataaaggaatacctgagactgggtaatttataaagaaaagaggagtatttgggctgatggtttgcaggctgtacaaacaggccaccagtatctgctcagcttctgctgaggcccgggaagctgacaatcatggcttaaggcaaagggggagctggcatattacatggggagagagggagcaagggagatgccaggctcttttaaacaacaagatctctcgtgaattcatagagcaagaactcactcattaccaggaggacagcacaaaaccattcatggggatccacccttgggaaacaaacacctattactaggcccacctccaacactggaggtcgcatttcaacatgagatttggaggggacaaaacatccaaaccgtatcactaacggaaaattattgtttaaatttctgtattcagtcccttggcctttttgagaaatgccattcatttcagccatcaagcaaattattatttgagacatttatacctcttcatcctttaaaagtttcagaagcatgaatttaaaaagtattcattgtaaatttgaggctagtcaaattgatgtggcatctaagtagcacggtgatgggatgaggagacaaagtcacgagggaaggtaggaagaagcagagagaaaaagagaaataggaagagagaaaaagaaatgaggagagagtataagaaaaataaagaagaaagaggaaaagaaaaatggtttaaatgagaggcaaatgtcatctgatgttttaccatggggccatagggtatttgaagattcagaaaattcgtaagttattaaaaaatgtgactctagggtagtgaggttataacttgtaagaaaacaagaagtgattccttttaagagagccttcttggccgggagctgtggctcacgcctgtaatcccagcactttgggaggccgaggcgggtggatcacgaggtcaggagatcgagaccatcctggctaacacggtgaaaccccgtctctactaaaaatacaaaaaaatagctgggcctggtggtgggcgcctgtagtcccagctactcgggaggctgaggcaggagaatggcgtgaacccgggaggcggagcttgcagttagccgagatcgggccacaccactccagcctgggggacagtgagactccgtctcaaaaaaaaaagaaaaaaaaaaagtttaccctgtgcaggcactataactaagagtccttcccatctgagccttgccttccagacaactccaccaatttataagacagaaaaaaagcaccttgcaccttccagactgacttgtttgccagccgactagcactgagtcaccctagttaatgatgtgagagaggaagaatcactcagatgaatcctgctggaatttctcacctataggatccatgagatataatgaagtggtcgttgttttaccttattaaatttagggtagtttcttttttctttttctttttttaaattttttttttttgagacggagtctccctctgtggcccaagctggactgcagtggcgcgatctcggctcacagcaagctcccgcctcccgggttcacgccattctcctgcctcagcctcccgagtagctgggactaaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaaatacagaaacagattgaaagtaaagggatacaaagatacaattaaaatagtaaccaaaaaagagctgaaggggctgtactaatatcaaatgtaatacactttaaattaaagcagggctgggcatggtagctcaggcctgcaatcccagcactttgggaggtggaggcagagagacacttgagcccagaagttcgagatcagcctgagcaacatggcataatcccatctctacaaaaaatacaaaaattaggcgggcatggtggtacccacctgtggtcccagctatttgggaggctgaggtgggaggatcatgtgagctggggaagttgaggccgcagtgagctaagatcgggcccctgcactccaccctgggcaacagagcgagaccctgtctgaaaataaaaaaaaataaaaaacggggttgagagacaaaaaaggacatccttttttttattattgtattttgagatggagtttcgctcgttgcccaggctggagtgcaatcgtgtgatcttggctcactgcaacctccgcctcccgggttcaagtgattgtcgtgcctcaggctcccgagtagctggcattacatgtgcctgccatcacgcccagctaatttttgtattttggtacagacggggtttcaccatgttggccagggtggtctccaactactgacctcaggtgatccacctgccttggcctcccaaaatgctgggactacagacgtgagccaccgcgccagccgaaaccttcattttaaaaaaggctgggtcaggcatcatgcctcatgcctgtaatcccagcactttgagagggcaacgcaggcggatcacctgacgtcaggagttcgagaccagactgaccaacatggtgaaaccccgtctctaccaaaaatataaaaattagccgggtgtggtggcacacacctgtaatcccagctactcaggaggctgaggcaggagaattgcttgaatctgggaggtggagtttgcagtgagccgagattgtgctaccacactgcagccagggtgacagagtgagacgccatctcaaaaaataaataaaggctgggtgccagatgtggtgcataggcctagtttgttgactcctgtacttaacatataaaactctaaagaacagtgggaaggagcttccctctagaggcacaggaccggccaagttggtccctgagcagtgactttataataacatgttacactgtgttttttgtttttgttttgttttttgtttgtttgagacggagtttcgctcttgttgcccaggctggagtacaatggcgtgatctcagctcaaaacaacctctacctcccagattcaagcgattctcctgcctcagcctccaaagtagctgggatttcagtcatgcaacaccatgcccggctaattttgtacttttagtagggatggggtttctccatgttggtcaggctggtctcgaactcctgacctcaagggatctgcccgcctcggcctcccaaagtgctgggattacaggcgtgagccaccacacccagcctatattttttttctttttttttagacacagtctgactccgttgcccaggctggagtgcagtagcgcgatcttggttcactgtaacttctgcctcccaggttcaagcgattctcctgcctcagcctcccaagtagctgggattacaggcatgcaccaccacatccgactaatttttgtatttttagtagagatggggtttcaccatgttggccaggctggtctcaaactcctcacctcaagtaatccgcccgcctcggcctcccaaagtgctgggattacaaggcgtgacccaccgggcctggccctgtgtgttgttttatgtatgtttctatatgtgttatatttcacaataaactaaatattaaaacaaagaataactgatagctatgcacaaaggtatttaaatttcaccctcacaaataattttttttttttgagacaggatctcactctgttacccaggctggagtgcagtggcaccaccttggttcactgcagccttgacctcccaggcccaagcgatccttctacctcagcctcctgagtagctgggactacaggcacactccaccacacccacctaatttttgtatttttggtaaagatggggtttcaccatgttggccaggctggtctcgaacttctgggatcaaggaatcctccaaccttggctttccaaagtgctggtattacaggcgtgagccactgtacccggccaagaatagtttcttctccttacctaggtagagacctctgcagaaatgctgggagatctttggagaggggagattttttaaataaaaaatttaatacttggaggggcgtggtggcttacccctgtaatcccagcactttgggaggccaaggcggacagatcaggaagtcaggagattgagaccaccctggctaacacggtgaaaccccatctctactaaaaaaaatacaaaaaattagctgggcatcgtggcgggcgcctgtagtcccagctactcgggaggctgagtcaggagactggcgtgaacctgggaggcggagcttgcagtgagccgacatcgggccactgcactccagcctgggcgacacagcaagacttcgtctcaaaaaaaaaaaaaaaaattaatactttgggatgccaaggcaggtggatcacgaggtcaggagttcaagaactgcctggccaagatggtgaaaccccgtaaaaatacaaaaatttgccgggcttggtggcaggtgcctgtaatcccagctattcaggaggctgaggcaggagaattgcttgaacctgggtggcagaggttgcagtgagccaagatagcaccactgcactccagcctgggcaataagagtcagactctgtctaaaaaaaaaaaaaaaaaaaactgatctagttcaaaacctcactttgaatccacccacattgctctaaaatactttcatctttcctgtggctaaaaccttaaagccttgccagtaactcccattgcacttaaggaaatccaatctcccttgttgtggcccctgaacaggctgctgctggcccaccacggtgcctctagtttgtgtaaaatgcatatgttaatttataatatatgaggcttttttagctctaaaaggctattattcactagttgctgtgtgaatcagtatttctgggtgcagttagaaattattagagttgatgcccaagactcatctccatcagcacgggggaggcatctgctcgttttatggtcagtgactctgggcctcctgctgggctaagtcctgaggtgggtctgactcaggtcagagctgtgcaccccggccctcctcctcaacgtgcatgagtgctctttaggatggagctgaacactggcttctcaaaaccacttggccccatcacaggccctgagaactgattgggtcactctggtgggctccccagccctagccaagaagggtttctctagggagcctggccccccacttatgagacctggagccccaaagatcctgaccaggggcctgcctcctccagggagcggccactcgcccccaccaagctcccttcacagagacccatccaacagagctgaggaaaaccatgcctcataaatgaataaatacataaataagaatgccggggacctgtggattttgtaattcctgaaagaaggcagagtggctggctcacagcaagcgcagtaggagatactgctccccggccaggctgttctctgtctctttggagggagccctagggtacaagaaaagccagaggagaccagctggcccagaaggtgcctctccaccccttccccagagtttctgggaaacaaagcccacccgagggacacatgccttcttgggagttgtaccaggcctccttcctcatccagccatgcagtggttttcagtgcccgaaacagatgaataaaataggccctttacgggatgttcttcaggaacatgcacacttctttggatcttaccatcgttttatctctatttaaagttaaatgctgtgttatacagagtattggtaaagatgtagagctacaagaactgtcaagctggcagtagcataaaattgtataagcacattggaaacctgtttggcagcttctactaaagctatatctatgcctaccttcagaaattccatcctaagcatgtacacaagagaaacgagtgcatatgtccacaaaaagacttatataagaatgttcactgccatttttattcataagagccccaaatgaaaacaacctaaatgtccatcaacaggagagtgaataaatggtgatacagtcacatcatggaatactacacagccaaaaaagaaaaatgaagtggtaggaacactcaacgacatgggtgaatagagggagccaggtatgagagacagtgcacagtaccagcccacctagatgaagcgcaggaaggcagaactgacgatgattgaagtcagaagggtagtttcctttgtgggaaagtgtaggtcaggaaggagccttctggggtactacaaatctgccgtattttggctgggtgcaacagctcacaccagcacttcgggaggcataggcgagagggtcacttgagcccaggagttagagaccagcttgggcaacacagcgagatcccatctctacaaaaaaattaaaaattagcgtggcatgctggtgtgcacctgtagtctcagctactcaggaggctgaggcaggaggattgcttgagcttaagagtttgaggttgcagtgagctcccaaagtgctgggattacaggtgtgagacactataccagcctgatttttaaatactgaccaagccttgtgttactgggataggcatcacttggccacgatttactactctctttctttcttttttttttttttttgagacagaatctcactctgtcacccaggctggagtgcattggtgcaatctcagctctctgcaacctctgcctcctgggttcaagcaattctcctgcctcagcttcctgagtagctgggattagaggtgtgcaccaccacacctggctaattttgtttgtttgttgtttgtttttagtagagatggggtttcaccatgttggccagcctggtctccaactcctgacctcaagtgatccaccctccttggcatcccaatattcctatgattacaggcgtgagccactgcgcccggccctattctgtttctatattgctaaatttgacttgctaacacgtttttgaggatttttctgttgatgctcatcagggatgttggtttgcagttttctttctttgtattatactatctcgtctggctttctgtcaggggaaagctgaccttatacaaagtattggcatgtgttccctccttttccattttctctaagggattgtgtagaattagtgttatttcttctttaaatgtttttgaatccatctgaacctggagatttctttctaaaagattttacgccgggcacggtggctcgtgcctataatcccagcacgttgggaggctgaggcaggtggatcacctgaggtcaggagtttgagaccagcctggctaacatggtgaaaccccgtttctactaaaaatacaaaaaattagtcgagcttggtggcgtgcgcctgtaatcccagctactcaggaggctaaggcaggagaatcacttgaacctaggaggcagagattgcagagagctgagattgcaccaatgcactccagcctgggtgacagagtgagactccggctcaaaaaaaaaaaaaaattttttacaaattcaatttatttaacagatacagaactattcaggtaacctgtttgtttctaggaggattttcctggtttgtggcactcggacattgctttatttcatctaagttgtctgatttttaagtgtcaagttttccttagtgttctcttgctaaccgtctgaagtctgtggggcctgcagtgatgtcccttcattcattcctgatactgataatttgtatcttttctgtttttttctttgtcagttttcctagagtttttcaattttgttgatcttttcaaagaatgatctttaagtttcattaatttttcccttctttttttgctttcaatctcattagtttctgcttttatcttggcatttgttcctttggcttgttttgcgttcactttgctctttttctggtttcttaaggtggaaacttagattgctgatttagacctatcttttttgtaatatataatgatttgatgctataaattttcctctaagcagtgctttaattaaacccacaaattttggtgcattttcatttatgttcaaaatattttctaatttcttttgagaattgttctttgacccatggatgatgatgatgattattattattattatttttcttcaatacggagtttcactgttgttgcccaggctggagtgcaatgacatgatctcggctcactgcaacctctgtctcctgggttcaagcgattctcctgcctcagcctcctgattagctgggactacgggcacccgccaccatgcccggctaattgttttgtattttcagtagagatggggtttctccatgttggccaggctgatcttcaactcctggcctcaggtgatccccccaacttggcctcccacagtgttgggattacacgcgtgagccagtgcgcccggcctgacccatggattattaagtatgttgttttattttgaagtgtttgcagattgttttgttaatgatttctagtttaataccattgtgattggagaacaaactgcatatgatttcatttcttttaaatttgttaagatttatgtgtcaggttatgttctcagtgaacattctgtatgtgcttaaaaagtatatgtatggtctgtatatgtatggtctgtatatacatatatgtatacatatatgtgtaaaaagtatatgtatggtctgtatgtgcttaaaaagtatatgtatggtccagcactttgggaggccaaggcaggcagatcacaaggtcaggagatcgagaccatcctggctaacagggtgaaactccgtctctactaaaaatacaaaaaaaattacccgggcatgatggcgggcgcctgtagtcccagctacttgggaggctgaggcaggagactggcttgagcctgggaagcagagcttgcagtgaactgagatcgtgcgactgcactccagcctgggcgacagagctagactccatctcaaaaaaaataaaatttaaaaaaagtatatgtaaagtgtatgtatggccgggcacggtggctcacgcctgtaatcccagcactttgggaggccaaggcaggtggatcacgaggtcaggagatcaagaccatcctggctgacatggtgaaaccccatctccactaaaaataaaaattaaaaaaataataataattagccaggcgtggtggtgagcacctgtagtcccagctactcaggaggctgaggtaggagaatggcgtgaacccaggaggcagagcttgcagtgggctgagatcccgccactgcactctagcctgggcgacagagcgagactctgtctcaaaaaaaaaaaaaaaaagtatatgtattttgctgttgttgggtgaagtgttctataaattagatccagtttattgaaggtgttctacagttctcctagatttttgccgattacttgttctctcactatgaaaggtattgtgtgtgttatatgtgtctaacaattcattgtctagttagagttgctattataccacttcaagtggatggagagcctcactgccatccattaatgtgcattaatcattttgagagtgaaaagattttttaaaatgtttttacttttttaggtatggccaagtgagatggggctagtgaaatgggtgggagaattggaagctgatagtgtgtgagctagacacccatgaatgcttttccactgggcagttagagggatgataggtaataatataaggcagctccatcacacaagctggtgactcctgtgcgacagaccaagagctgcatttggagattcatttccgattgttgcgtttcctcttagagcattgcttggtcatcgtgttctgagtggtccattggcctccatgtcccttttggggtggatatttgctcagtgacttttgagcagctggatctcctgcttcggcaggtgagtgaggggatggatggctccgcggactggcccccgccccaggagaaagagtgcgtggccgtggcaacgttgaatcttccccgacttcaggtattcgtgatttcccttcctcttgctccttttataagtgtcttagcgatttgtaagaaggtttatgtattctgaaggacataggttttagcctgttgggggaagtattttaaagtaagattgtaatgcactaataatggacgcaaggcttaaaaaacttgatctgtttattttatgtttgtcctggaagtcagcctcggcatgcaggaagagtgtatatggattgtgttatttttgctataatcattagtttgttggtattcttactgttttactgttggtgcgtgtggagaaatgactgggtgagatcacaggtgatggagagagacagagctcagctgagagaccagtgctggcctgtctctcctctgtcctgtgaaaaccctgctccaggagggtccagtcttttggtttccctgggccacactggaagaagaattgtcttgggctacacataaaatacacttatgatagctgatgagcttaaaaaaaaaatcccaaaaatatctcatgatgttttaagaaattttactttgggccacattcaaagctgccctgggccacatgctgccctcgggccgtgggttgaacaagcttgatctactcagtaagctcggctcccaaagcaataccttcctttcctcaccatgaaggctgtggttagggtcacaataaaagctacaaaagccttcctccctagcaaaactaaagctgaagtgtttgatcatcatcttttgtctttgtaataaaaccctctaacttaatgacaagaaccacggttttctcgacatagtaatttttcccttttattacagtggtttcttgtaacaacccgtcatgtccctcttccagcccctcccctttttgccctgcttctagaatgtacagaactgagtgtagtgtttagttgcagtaatgaactgagcagaggtctggagcatgcttctcctctagtcctctgtagcactcatttatcaccatacctgtggcatcctggcgtttgcgtggttgcgccccaggtgtttgctgcccctcctggtttgcggtgatgtgtctgttctggtcagtgctgtggggcgtggccttgcgtatgtcttaggctgtcgaggtgtcccagcgtatggttttgcatttgcctctccggggtcctgagggttctgtaggtttcacagactccaggtgagtttcggtggtcatttcctgacctgtgatatctatacctagatgagtggtgtgcttttgatttcacttctactcacagggcaaggccgggtctctgatttctcatggggcctcttgctacccagagcctgggacgggcagtgtgttgccccctggctgcggttggctggcaggcaggtgatcctgagtggctcccagccttctgcaggaagctcgggttcagtgggtccttgtgtgcattcccgtgtgggaggttgtgctgaagcctggcggcttggctctgctttcagagcccggaacctcttgactcctgctgtgtgtgcccatgtgaattttggttttgcacttgaggagtttccctgtgtactctcagctccgcagtctaatttttagcagctcttttttttttttagacagggtgtcactttgtcacccaggctggaatgcagtggtacagtcttggcctgccaggttccagtgattctcctgcctcagcctcccaagtagctgggactacaggtgtgtaccatcacacccggctgatttttttatagagatggggtttcatcatgttggccaggctgatcttgaactcctgatctcaagtgagctttcccgtcggcctcccaaagtgctgggatgacaggcatgagccaccgcctgtggcagcttttgtggttacattgtagccattatttctgtgtttggtgcagattgttggggcggggtggaggttgctgttgctagttgtttagctcttctgctcatcttgagcttttccatatatatgttcatagcggggttaaaaaaaattcctctagaaaatatttcaactattgtgggtaagagtttttttagtccagtttttaaaaatacgtaaactgagaagttattttgtctatttaaataatacttcaaattgacttttattcagtgtttaataagactttgaaattcactcatttttaggggttctaagtgaaaattgtttttctcctttcagttgcatgctgccattagtcaccaggttgacctggaattccttggtttaggtctgggcagcgtcttcctgaacagcctgaagcagaaggtggtgaccctggcaagcagcgcagacgtgctgagcaccgtgcagtcggcctcccaggccatgctgcagagcggctggtccatgctgttgcccaccgctgagaagcaggcccgggcactctgctctcctgtcctgtggaggtgggctcggggaaggaacaggagagggcatgggtcagggtgctgggaggggatggcgtttcactcaaattggcacagactttctatttcagtttcaggcaatgaagtgaacataagtccaggtcatcgattggtgattgatcttctggtgggcagcttgatggctgatggagggttggagtcagccttacacgcagccattactgcagagatccaggtatggccttggaggcacacgtgacctggtggtgggctgagatcggaaataccacactcacacatgtgaagaataactgaaaacagtaaaacactaaacttatatccaagtatttttttaaattaaaattcttttatgtgctaattttaaaaattattgagatgatttgtgataaaatactgcatgttgtctgtttcagtgaagttaacaggtaacctgttcctcatgtagaccattcccgtcacccggaaagatccctgtgctccttggcacttgcagccaggatactcccctgccctgagattagattcatttttcctgctctgagtgtcgcagcaatataactgtatagtatgcactctttcctgctttgccttggagaatgattttcagattcactcactgttgtgtgtattgcgacttcgtttttattattgggaagttttccattttataggtgtagtactgtttgttagttcattctcctattgaaggacatgtaattgtttttggtttttgttttctttttttttttttttttttgagacagggtcttgctctgtcacccaggctgtatacagtgacctgaggttggctcactgcagccttgtcctcctaggctcaaatgatcctcccacctcagcctcctgtgttgcagggaccacatacatgtcaccatgcccggctagttttttgatttttttgtagagacaaggtttcactgtgttgcaaggctggtcttcaactcctgggctccagtgatccccccaccttggcctcccaaagtgttgggattacaagcgtgagccaccgcgcccaggctttctggtttttggccgtgtagagctgccacaattgtgctgtgaacaagtactttagtgaacatatgttctccctttggataaacacttggagtggaatttgttaggtcctggggtaagtgtgtgttcatagtttcccaaagtggctttgccatttgcatttgaaccaggacttttgtgtgtgagaattctagctccttcttgtccttacagagcagctggatgctgcgtgtgtggagccgatcacattgggttttgtgtgagccattagcagggttaaggattttagggacttcacagaaggaggctggagagcatcagcagaggcagcctggaccttggatctgtaaaaagaagacactgtttgaaactgcacaaatgagttggggtttccaacagggcaggtggggggcctgtgggtggatgggtgtggcagccacagaggctgggatagcttggcactggggtcagggctcagccagcctgtgtgccttcacacctggtaatgagatcacttgtaaacaatttctgtttgtcaattacaggatacaaaaaaagaagcacggaaggaaaaagaaatttatgaacaggaggcaaatgcctcaacatttcatagaaggaggactccattggataaagaccttattaatacggggatctgtgagtcttctggcaaacagtgtttgcctctggttcagctcatacaacagcttcttaggtaaatcatattagctgtattgtattgtgttttatttatttacttttttttttttgagacagagtttcgctcttgttgcccaggccggagtgcagtggtgcgatcttgactcactgcaacctccgcctcccaggttcaagtaattcctctgcctcagcctctcgagcagctgggattacaggcatgcgccaccatgccccactaattttgtagttttattagagacagggtttcttcatgttggtcaggccggtcttgaactcccgacctcaggtggtccatccactttggcctcccaaaatgttgggattacaggcattagccaccacgcctggcctatttatttacttattaatggtgttttttgttttttgttttttttttgagatggagtcttgctctatcgtccaggctggagtgcagtgtcacgatcttggctcactgcaacccccgcctcctgggttcaagctattctcctgcctcagcctcccgagtagctgggactacaggcgtctgcaaccacacctggctgatttgtgtatttttagtagagatggggttttaccatattggtcaggctggtctcaaattcctgacgtcaggtgacccacctgccttggcctctcaaaatgttgggattacaggtgttagccactgttcccggcctgtattgtattttaataggtgattattggttttcatattaagatagtgaaatctagcgcaagggtctcaaaaatttgtttgatgattgaaggaatattctgaaaattacctagtatagatgttaggataaagagcagacccttctcaatataggtgagaggagaagttggagggtgtgatgatactcagaagtttttcacagaagagaaattggggcgtgcagtaaacatgtaaaaagattcttactaataagcaggtaggtgcgaatgaaaatcatcatggaaggttatttttaaaactggttctatcattgcctcactttacatattacagagttgtacctactactttgtaagataacttttcttttcaaaactgaagtcaatgtgatagaatggtgagcattattttggaaggccagactaggaggaggtgggaggaggaagtcagactcagcctgtgaacagacgctaaccttggcagaagccaaaacagtcagacagtgttgtgtaaaaatgatcattcaagaagagcgaaacagcaaggtgatttgtgaaagagatttattagaaaatgaaacacatttatacctctgttcaataaaaatctgcttttcgtcaactgatgctcctggtttttgtttctacacatagagaaagcagagccctggcagcttgggtcaggcagccgagtacagaccagggagccctgggcagtggctgcagctctcagctggcctgttcatggggccatggtgggtctgtggcgtggggtgggcccgtggcgtggggtgggcccgcggcgtggggtgggcccgcggcgtggggtgggcccgcggcatggggtgggcctgctgtccacagccagcaaaactaacttagtgcacacacagtgaaattttgaaacaggaagttttagagctagtttctgtcatagattttagtaaatgctattttgcaaaacctttttctgatgtttgttttgtttttctaatctgataatgcatatttcacacattctggtctttaacaaatggaaataaagagaactaaacaatatagtttgtgtcgatggaaagagcttgggatttgttctcagaaaatttcagttacaacagtttgttcatataggtggacttccaacacagtaactataggagtaagaataaaagctgtgtttactttcacagagttaattaagaatacatgagaaaatggatgttaaaaaccttgtaattaaaatgtacagttacatgcaaagttttaaagtgagcattttccagaggtgcttttctaagttcttgaatgcctctcccttttctgaagtggctgcttcgtggggctgttggtctttggcagggggtgagtgcagggttcctgttgtgggtcctttgttctcacgagggcagtgcccgttttccccgtctcctgcttgcccagactgttcccgtgcgcagagagactggcctgtttgacctgcagctgtgctgtttgagctgcagctgtgtagcctgcgctggcccatctggctacactcaacaccgtttgctgatcagcacttgaagtctgtccgtcatagctgagacactgaatattttatctgtttaatttttattcattaaaatgcaggtttgaaaatttgattctgttattagaaagcacttaagtatgtttagaatcacttggccttgggagtctactttgtcaactgtgtattttatgagtctaaatggagatcagatgttttcaatgcaaatttcacggtccaaattgaaatgtgttacatatgtaagctactcagatggtttttgaggacttaatatgaaataacctatgtaaaatatctcaataatttttcttagattgatttcatgttgaaatggtcatatttttgatctgttggaataactatgatacattattaaaattatttttattttttaagatggaatcttactctgttgaccagaccggagtgcagtggtgcaatcttggctcactgcaacctccgcctcttgggttcaagtgattctcctgcctcagcctcctgagcagctgggactacaggactacagactcccgagcagctgggactaccaccacgcctggctgatttttgtatttttgtagagacagagtttcaccatgttggccaggctggtctcgaactcctgacctcaagtaatctgcccgctttggcttcccagagtgctgggattacaggcatgagccactgcaaccagccattagtacaattaattttatgtgttgttgtttttcttgttggtgtgttttttttttttttttacttttgttaatgtgactaagaacaattttttttccccacccggagatggatcctcactctgttgcctggactggagtgcagtagcacgatctcagctcactgcagcctctgcctcctgggttcaaatgattctcctgcctcaacctcctgagtggctgggactaacagaagcatgccaccatacctggctgatttttgtatttttagtagagatggggtttcaccatgttggccaggacggtcttgaactcccaaactcaggtaatctgcccacctcagcctcccaaagtgttgggattaccggcgtgagccaccgcacctggccatgtttattaatacgactaagaacattctgaattgcacctgtggctccattggtgtcctgggcaggtggctctgtgctgtccacacaggttgtctcctgtgtcttcgtcttcgctgcgtgtgactttttggttcctgtggcacgtggggtcctgtatgggacattggttctacagcagatttatagtaaggatgtacctactaaaaaatacaaaatagaaagaatagacacaaacatagaaataagtatcacctcacaaaaattttggaaagtagaaaaagaaaaatgcattcgcagctttccagtagccgatatccaggctgtcttcataagcatggatcatgtgtccctctcccgcatgggtagacactgttttctcaccttaagtgtttgtgagtgaaggattcttgatgtgttgacttggcagatgcagttgttgaacagtagtttatctaaagatcgtaagagacttttggagacatttcatgtccttttttcccttggaaaacgtgagttggagaaatcgctgcttgccaaaaataagccgtgaaacgtatttcagagtagatcgttatttacttgctggcgaggagccacagaataccatttacatttgaaaatagagcgctgcaaagtttttataagtagtgaatcccatcagaattacacattttgattatggctctaaattttatattaaataaactaaaaatttcattgtattgtattaccgtctcttgctccttcaggtgtagcatacatgctagattctagacctgtttcttgtgttacagtggtgttatccaggcagggtatcatgtagtgaaggtgatgtcgagtggtggtggtgagcccagtgaaggcgcatccttgccgtgtgtgatgagggcctgtgggttgctatgggattccccaaccctggctcctctgtctcctgcttctgtccttactcacactgctggtagttttctggtgtgagacacgggggcaagtgggattgacaagcctgctgtcacattaggaacctgagttaaagtggagctgaaagcatgtcctcgctcttgatgttgtgcagagagccacctgtgctcctggctcaacggggcgggtgtggtgggtctggaaccaggccctggtttggctctcctcccctccatgttcccctgtcctgtctgatttgcttcacactgacataagagttactttccctcggcctcccaaagtgctggtattacaggcattagccaccgcgcccagctagcatcctttcaagtactggggtacacccaagctcccagcttctagctaggagtcattttgtccctctttatcccaaaggacttgccaccatctttggttcccaaagcccaggagggtccaggctcttcagcctccaaccactttgcatttcttgtctgcttttcgttcatggagataattaacttatttttcagcctgggcatgtcttttttatttactttattttttatttttattttttgagatggagtctcactctgtcgcccaggctggaatgcagtggcgggatctcatttcactgcagcctctgcctcccgggttcaagtgattctcctgcctcagcctcctgagtagctgggactacaggtgtgcaccactatgcccagctaatttttacatttttagtagagacagggtgtcgccatattggccaggctggtctcgaactcctggcttcaagtgatcctcctgcctcagcctcccagagtgctgggattacaggcacgaccaccgcacccagcctttatttactttgtatatctcatctattactgctgcagtttgcagaagagaggatgccctcaaacctaacttctccaaaccatcccaaatgggaagtctgctccacgtcaacagcattgttgcttttaaagactatacgtcaacatggcagattatagcaaaaggatgtcgagggagcaataggaaagcaagcctgagagtcctggagagaaggtggcagagctgccttttgaaggtggttccttcctcagaccctgcccttcctgccttgttcctccagttgccagatttgctgttggagctcctccacgggcgaagaggtgaggctggactgagagggagatggagaagctgccagagattcttttggatctagaattgagacagcagttccagccaggtccagaggtgggggctgtcacccagcccccaggggaatggtactgattgcagaatgtggcgagaactccctggctgggagagggaggtgcttgctcccttgaatcacctgagcccaggctggaaggcccaagggggaggacgaggccagctcactccagctccatcccctccctttaaccctaagctagttaaccctcccagactccagtcctttttcctaagtgccctccctgcaaagtctgcaccgagcagcgctccctcgcaccagctcaccctgcactgtcttgtctttcagcaaccccatgggtttgaacttgagacgattcattttcctaaaagcctctttgggctgagggaaggcatgggtggctctgccagttttggagtgggggccgactcttctcagagccgctgcaagggccagggccaccctcccaggcgggtgtctctgggctgggcagcagctttgtaggcagcctgggtcatccccactggcctgggaagctgggggtgcaccggctcctgctcctgatagggccaaggcaccttccttacctaagagctgactttcttgaagagtgggcacagaggagccggcaacctgggctgtgtaggcacccaggagaaaatctgcagctcagtatcagaagtctccaccagcacggctgttgcagagatggggaaactgggctgagagggaagggggcttgcccaaatcaccagccctggaatgttttgagctttgggggtggatctcccaggaaacgtgttttatggcaccaccgcctctggtcacccaccccgaggtgtggcgggcctggacagccagcttgactgagggccaggctggtgaagtcaaaactaccactcaggaagaagacctagcccttctccagacagagttcaaatgtgaggactgccttctttgggcctcaaattccccacgtgaattccaaggacccctctagctcctacactctgggccaaggtttcctctgagccgcagtcagcctagaggacctaggatacatcttccttggacagagacccaccataggggcagcaggaggtaggggtgggggtaggcaagattcctgtggggaggtggagctgtcatcagagatggtgtctgcaggcagtgggtgtatcgtggctctgctactacttgctgggtggccccatgacgtttctttccccactctgacctcagtttccctatctgttctgtggagataagatgcctgcctacatatttgtggactgggatgtgtgtgggccagttgcagtgtttcttggtgtggtcctggggcaggctgcaccaccccatagagatttctgggccccaccctaggctcacaggaccagaatctctgggaatgaagcctgggaatttgcatttccacaggcatctggctgattctgacatgactgaaaagcactaatagtatatagcaagctctttataaaaggtaaattcatagctgccttttactaaacataaatcttaccttcccttcctcagttaaggacacacaccgcagttgaaaatcactgtgcctttccagatgcagagtctgacctttccgataagattctgttaactgctgctttctgcagtttgtattccaaaacaaggggaatatgtttccattttttcaatacaaatgtttaagtcggatatgctttctcaaactggacacacactcacacagcttagggtttcagctatggcttcctctcaaattattagcctctttctgccagggagcagtttttcccagacaagaccctggacagaggttggtggggccctcctcatcagaatcactagattatgactgacccctagaggtggcttttctgcttaagtgtcagcccatgggctgggttgtgacccccaaagctgcggcagaagcttccacccatcctgggtcccccctgccatctatggggaaaggcctgtcccttgtcttctgggcccagccggcctcacaggcattcagcagattggaaagtcgaagcatgtgctgtgcttggctgggctctcctgcgcccctttttggggtgaggtggagtgcatccagcccccggcatccctgccgtttattcccacccctcatccccacccccatacacactcacaagtacaaacacaagcacagtcactggcacacaccactctggacagcaccatttccagcctcagcggggcagtttccttacagggaagttaatgaggcactaacgaaggctcaggggacagggggaacctctatcgagaagaggctcctagacctggttctgcctctgaattgctgggggtccttgagaaagttgctatccctctctggtctcagtttcctcaggtgagaaatggggggccggccaaatggtctaaggttctgggaacctctaaatcagagcccgtagctggtggtcaagatgagggagaggccctcagggtcagccgaatgcctgagaggcaggacaggcccaaaggtgagcaacgtgagcacatcaggtgggctcagagctggcgcatgagccccacagcctgcagagcagccctgtactcgggagcccgctcacacccacccagtgggacttcagagatgtggggtccagcctttcctactattgctgggctgagggctgggagctgcagattctgaccccacagctgccttagacatgccagatggtctggggcaagacacacccctctctatgaaatgagcagccagtccaaataggtacattagagaagggctgtgggatggacccagctgtagcctggggctacagactggcttccggggtactcaagcagctggcctctggggtagcagccccaggtatgagaggcaggactcagaatctaggccaagcctccataggaatcccctctggagagcccgggcactctgcaggaggggcagcaggcagcaggtgcaccaggagcatgtttcacaaggtgcccaatatcgcatctgctcagataggcagcgagttggaaagtggatgcaataggcagggtggcggctgctccccacagccaggagtccggcccagcacccacctgagtccgcctcagtcctgctcaattgggttatccgtgctcttggccctctggtcccacccacagagggaggtctttggggcgaccaggtgagctggcccttgtgggaggatgtaactgactcctgagcctggcgagccaggcagcccctcgccaacatccccacccctacctctccagcccccccgcattccctgatcctcccatccgctcccctgacccagcagttgcctctgctcactctcttttcctgctcccaggctcgcctggtcatgtgtccttcactctcctctgagtctccctctttccaagccgcctccactctacttgacacactctcccttaagacaccagagtacacaagcgcaagtccctgcacctcacctttactcccagacatgggagggagatgacatgaagacccaaacgccacttagcaggagatctggggtatgcagaggggcagaacggaggctgtggaagctccaggggctccctgcaggaggccacatgtaagctggctattgaatgtggctctgagctgagacctctccttgaagctccagaccaggagccagctgctagctggacccctccatttggtgcctcagagaaactttgcactctgtaggtctaactttgaacccagaaaattcccccatgtcggccctgtctcttcacagggaaagcaccacctcagacccagttctgcaccaaacccacatttgagtcacgaggctcctgccctgcactgtgagcactctggataagccagtgctgagggggaaagagctctgaatgccaagccaaaacatgagcttcaactccacctccagctctgagagctgtgggtagggaagggccctcgtccagtttgctgtagaaagatcagtctgccactgtatggcacatggatggcaggggcagagtgcaggtggagagaatagaaggtgggcagggcgggggaggcagggacatggctgtagccgtggagatgggaggacagacaggacttggtggccacttgggtgaaccaagggaggagtcaggaagagacacccagttttgtatcagatgtgtagagcgtgggatgctgttcattgacggagggaggaggaggaggaagagatatggcatggggaggaggtagctgagctctgtcgtgaatgtcatttgaagtccccagggaaagccaggccggccagcaccttcactgcttcagccagctctcagggtgtctgtgctccctggccctctcagctcctgcttcatagctgtcagctgcagtgggagacagctgcacaagggcccagcatgtctgtgtgtttacccaggggactgccgcatggcccatgccgagcagaaactgatggacgaccttctgaacaaaacctgttacaacaacctgatccgcccagccaccagctcctcacagctcatctccatccagacggcgctctccctggcccagtgcatcagcgtggtaggtgcagagggtacctgtggctcaggctcaggtgaagaggaagctcatgcccaagccctaagcagtcaatgtccagaggaatgaaatgactagagttgacttagactcaccggtacacggtggggaggctggaggagggtccatgaggtttataggtgtccagtatttaatgaggtcatggttttgttaacaaagaagaaatgagggtgggagcgagatcaccactggctaggcagccaatgggcctgcatagactctgctcagctgagtctccagcacgaccatgagcttctcctcctcatcctcccagccccaccctactctctcccccagcttgctcaacaggtgaccttataggctccctactctttgcagggaataagaaccagactgggggaactgacgggtacagaggcccaggtgtaggcgcaggaccacaggcagtgaagcgtctactgacccaggcgggtgagggtctggagagtgggcatggctgctgcaggcatggaaagcaggcacagatggcggcactcccagggcccattgtcagggtctccacatgtggacatgtgcagaggtgggggtgctgagggaggaggggcagggaatttctcatcttctctctactgcctctgagttggagatgtcagagggagccatggcccactgtaaagtaacacaatgtccccacccacaggattagaacccctcccctggaagcagctctgaggggaacagtcacatgtagagagtgcagggcactgtgtccagccgggggaaggaggtcaccaagggggttgacccccctctggccaggtggctaccttctgacacaccagcctctgtctctagcacggtggcccccacacacccagcctgtgaaacctacagccctcaagaaggctttggccaaattaatgagcggctccctctcccaggaggaagcacgggtgaaggatgtggagggcagtagagttgtgtgtgctccgccccctttctccacagtcggatggaaagaagggggctttcagccaggctcgcccagcctggggtctgagtgtcactgtccagctattggcttcttgcttaatgggtgagcccagctgctcccgtgcagctgccgccctagtgagggtgaaccggcaggcgagttacatttctgaaagcctgggaatacagtaaatattaggctgtgggctgctgggccaggaagagttgtttatttttcagggtttgtttatctattgacttgatgagggagggttataggtacaaccagtttaaagatggaaattttgagagagcaggcagggatttagtgctgggtaagcctggtcaaagcggctcttttggggcggccagaatccagtaccaatgtcctcagcatgttcatcagctgctgggggagtgcgggacagcatgaaagcacaggagaactttctggatgatagaaatactctgtatcttcaaaggaggtgggttccatagtaatgttaaatgagttaaaactcatcaaaatgtaaaccagacctgtgcatttcactaatagaaattatacctccaattaaaaacatgttttaaaagacagatgggccggatgcagtggctcatacttgtaatcccagcactttgggaggctgaggcaggtagatcacctgagtcaggagctcgagaccagcctggaaaacatggtgaaatcctgcctctattaaaggtataaaaaaaaattagccaggcatggtggcacacgctactcgggaagctgaggcaggagaattgcttgaacccaggaggcagaggttacagtgagcagagatcgtgccattgcactagagcctgggcaacagcgcaagactccatctcaacaacaacaaaaaaaggacagatgaaggttttcaactttcaataaaggcagaggagcttgttacagattcgcctccccacaagagcagttagaaaaactggataaaaatgtgccccgcccccaatcaaaaacaattgttggaaggtaattggagacctcagtcaggacttgagtgaccaggcctaggaggtgatcctgacagtctgtagtgctttcccacatttggtgattggtcaacagtagagggctaagaggctaagaaactgagtatgaagtggtagttaagaggctggagagcctagctgaatgtttggcactctcacagggctgaaatgacctaatgagaatttgggtcccaggagggagatgggaccttggtggggaccctggaagggccacccctgggagtccaaatgaataaaacatagaccagccatcagaaaacctaaaacctgctttgaaccagcttagtcccgaagtagatgaaggcgatctgcccttactccaattgtgtgccataaactcaaagtcaatactctctggaggcagataaaagtttactatgaatgccaaaagacaacacaagactaaatgagaaagaccaagaagaaaactaatagaaacatacatgtaaggaagaaacttttttttttgagacggagtttcgctctgtcacccaggcttgagtgcagtggcacgatctcagctcactgcaacctctgcctcccaggttcaagcgattctcctgcctcagcctcccaagtagctgggattacaggcatgcgccaccatgcccggctaatttttgtattggccaggctggtcttgaactcttgacctcaggtcatccatttacctcggcctcccaaattgctaggattacaggcgtgagctaccatgcctggccagtattttgccacaatttaaaataaataaaatttttttttcaggtttgtgctcagactatattctaaacagtcacatggcggcttactcttctccaggccttgctgccggcttttacatgtttattgtctttgccttcttgtcatgtgctcattagatggcagcttccaggtgctcctaaggggccaggaaagagagtgagaaggcacggaggttgccagatcatcccccttggggccccgccctcatcaactccctcaaccgggtctcctgcaactatcggtgggccatctcggccaccgcttcgccctgagcttcctgctgctgcagctgggcagtgcctccttctcagaggccagctgctgataggcggccacgtactgctgcaggtgacccaggtaatggtctcgctgctgctgcagactcagcctcttggctcttcagctccacctgcaggataggcgtcagggtaggtagtggctggcttccagattctgggcccataaacagggtagtgagggcactgcggggctctgtcgcctacccaggcccctggccctggccccttcctccaggcctaaatgactgcctcccttgcctagaggcccatgcctccctccccagcctcaaatctcacacccttcttcccaccatttaaactgtaggccacagactggtggaaaagcagagggagccaaccaccatctgctaagttgtggtgaggtcgttctgtatgatctccagggtttgcacacacctccgcctgctccccccaagagctcggccttctgccccagcttccccagcctctcctccagctcctgcagcctcacctagtgttcctgcatcttctcctcctgctgccgcagcctcacttcctgctcccgcatcttctcctcctgcctccgcatcttctcctcctgttcttgcatcttctcttcctgctcacacatcttctcctcctgctcccacatcttctcttcctgttcctgcatcatctcctcctgctctcgtatcttctcctcctgctcccgtatcttcttctcctgctcccttatcttctcctcctgcctccgcatcttctcctcctgttcttgcatcttcgcttcctgctcacacatcttcccctcctgctcccccatcttctcttcctgttcctgcatcatctcctcctgctctcgtatcttctcctcctgctcccgtatcttcttctcctgctcccttatcttctcctcctgcctccgcatcttctcctcctgttcttgcatctcctcttcctgctcccacatcttctcctcctgctcccccatcttctcttcctgttcctgcatcatctcctcctgctctcgtatcttctcctcctgctcccatatcttctcctcctgctcccgtatcttctccttctgctcccgtatcttctcctcctgctcccttatcttctcctcctgcctccgcatcttctcctgttcttgcatcttctcttcctgctcccccatcttctcttcctgttcctgcatcatctcctcctgctctcgtatcttctcctcctgctcccgtatcttctcctgctcccgtatcttctcctcctgctcccttatcttctcctcctgcttccacatcttctcctcctgctcctgcctcttttcctcctgctcccgtatcttctcctcctgcctccacaccttctcctcctgctcccgtatcttctcctcctgcctccacatcttatcctcctgctcctgcctcttctcctcctcccatatcttctcctgctcatgcatcttctcttcctccctccacatctcctcctgctcccgtatcttctcctcctgcctccacatcttctcctcctgctcccgtatcttctcctcctgcctccacaccttctcctcctgctcccgtatcttctcctcctggtcgtgcatcttctcctcctgcctccacaccttctcctcctgcttccgtatcttctcctcctgctcgtgcatcttctccttttgcctccatatctcctcctgctcccttatcttctcctcctgcctccacatctcctcctgctcctgcctcttctcctcctcccgtatcttctcctgctcgtgaatcttctcctcctgcctccacatctttttctcctgctcccgtatcttctcttcctgctcccgtatcttctcctcctgcctccacatcttcgcctcctgctcctgcctcttctcctgctcgcgtatcttctcctcctcctgcctcttctcttcctgctcccgtatcttctcctgctcgtgcatcttctcttccagctcccgtatcttctcctccttctcccacatcatctcctcctgcctccgcatcttctcctccttctcccacatcatctcctcctgcctccgcatcttctcctcctgctcccgtatcttctcctcctgctcctgtatcttctcctcccgctcctgtatcttctcctcctgcctccacatcttctcctcctgttgctggttcaggcggttccacaactcgttctcttccacctgggcttggagctttgctgacacactctgcagctccttacccaggtggtcagcctccgcctgcagctgctgctggaatagtgaaagtgtttttttgaacctcagaaggaagcagaatcatgagctagccacataaatgtaatctataggctgggcgcggtggctcacgcctgtaatcccagcactttgggaggccgaggtgggcggatcacgaggtcaggagatcgagaccatcctggttaacacagtgaaaccccgtctctactaaaaatacaaaaaattagctgggtgtggtggtgggcacctgtagtcccagctacttgggaggctgaggcaggagaatggcgtgaagccggggggtggagcttgcagtgagccgagattgcgccactgcactctggcctgggtgacagagtgagactacttctcaaataaataaataaataaataaataaataaataaataaatgtaatctgtaaaataatggttttcatccatgatcctttaaaaaaatatttttaagccctaactcttgagattctgattccccaggcagggccccaatttgtacatttttagtacactctagaggattctatggcggggccagaacaaggacccaaattttccagctcttggctggagcctccccataccctgcatgatccctagaccatggtcccagctggatgggtctcccacaacccccggggctgcagctgctcacctgtggcagcaggagcttggccctctccagtttcctttttagctcctttacgttgagctggatctcagacttttcagattctacaagttgaagtttttcttgtagtttggcatttttctccttcagctcctcatcagttatgctatggccagaggcagtagagaaaggaatgaatgaagaacataaaagaccactttggtgattgaccccctaccctcgccccacaaccacagaaccgtggcgctggaagggaccccaggaattaaaagtcccaggtggcaggccagagagaagacatgagttgcctgaggctaccccatgagtcagtggcacagccagcactagagcttccgtgtgcacacatgaaaacatgtatgagcctctccccacactcacctggaccccccacctcccagcacaccacccatgctaagggcccccagacctcccattccaccttcccccatcctacgtgttcctgtacagttccagactcagggcgtccctctcctttgttaactcctcaatgtactgcaaatagagaaaggttaagtcaggatagagcaggcacagcagtagctggacgaccaggaacaactgctacagtgactactccacagtaacacttcctcactctcaatcacacctgacgtgttctcaaggcatttccaagcccatggtctcatttgtttttctttctttctttctttcttttttttttttttttggcagagtttcattcttgttgccctcactggagtgcaatggcacaatctcagctcaccacaacctacacctccggggttcaagcaattctcctgcctcagcttcccgagtagttgggattacaggcatgtgccaccacaccgggctaattttgtatttttagtagagacggggtttcttcgtgttggtcagtctagtcttgaactcctgaccgcgggtgatccgcccacctcagcctcccaaagtgctggcattacaggcgtgagcgagagcacctggccctcatttgtttttcaaagaactcagtggatgtggaagggacagggaaagagattgaatttagggctggctaacaggggcccagagcgatcagataatattgttattgttattactgttattactaccactgttggagcctttattgggtgcttcaccaggcactatgctaacaatcccatttaatcctcacaacctccataggagacggttaccattattacctctattgtgtagatgaaaaacatgcggtattaaaggttaagtgctgcctaagatcacttggagctggcatttcaacacccaggtatatctgattctctaagcccattcttccgctggaggtaggggcacagttaagaaggaggaaattaatcctttgttgaatttttgaaaggatgatacgttcgcatagtccaaaactcagaaagtccagaagggaaatatctccccccaacactgtgcctctatcctgagttttttaatgaatccttacaaacgtgttttatgtatgttaccataatacgtacacacacacacatatacacctgccccctctctccacacaaataataacatactcaagatactcttctgtacctttatggtacaagtaccctaaccgccacttaggacttggccaaggccacagccaagtatgggcagggcgggcacttggcctctgagatctatgtccagtgctcgctcctcacagtgctccccaactcacccacaacagccgactcagccccagtctgcctctaacaaccacacacaaaagcagcaagaaatggccatgctgccttctgggcaggacactccatcctacagaagggacctttaggctcactcctccatctgcgaagctgggctcccaagggacggggccgtgtttggactcaccctatccgccttcttcttctgtgtagcgacagcagagagagcctgctctaactctcctgcaaacttccatgaatcatgcaggcggctgatcagatccctggcctctcctggaatgagagacattcagatgtggcccaaaggactccccctaaaggcctgtcaaagtgccaggttgaaggatgatggggtgccagattcccaccttccaactgcttgacagcatgctggctgtagtaaagtgccatctgaagctcagttttctgacatgtaaggattcgtatggtttgaacctgggcctttgggagaaaagacaagcaaatgctgaaagagaagcaaagaaacattctccagagggcaggagggaacttcacaccctccactcacctctagctccctccttagggcttcctgatgttggtggcttgccttctgttcctatagaaagaggaaaacagagctcttgctagggggaggcagagatggcacagcaagagacatgcccccagaatggcaccactgccccagaacaggcccacccatgggaccagtttatcagggaccctgtggggatggggtggaatcttgggggtgagccttcttccccaggctgggagtgggtgagatgagcctggggcctctacatctgagtgcccccaaacccagcggtcatgtcgtgagcaaagaaatcacacgacttcttccagctgagctcggttctattgtttctgtggggagagtcaaaggaaggtgactgagggtggcccccttgactctattccccaggccaggaagcgataggcaggggccaggaatggatttaaaaggcacagttctcagacccaatgggaacatgaactggtcaactctcctcaactcccaaagaagaaggatttgggtctttttggtttttgcccacagccacagaactcaaagtctgaaactagattctcttgaaaagacagtaacagaaaccttcagaggtggagtgcgagaaaagcccacccttccgccagcttgtgatttagaaaggtgcattcactcagcaaacgttgagcacatacgggccagggacggttcttcacagcgggaatagaggtcagaaaaggcagacaggagcccttggccccgaggtttccattctagtgggcctttaactctcgggctctcagagctaacagaaacctctgatactctctaactctacctcaggaaacgcaagcccaagaaggagagtttacagcaggtcctggacgagggattaacataaaaacacaatgacaaatctcatttaaacttcacaaatgtaaggaaaacaataccactcgtattttacggatgtgaaaagagaggcccaaagagctcaagcaatttgcgctaaatcatatccctagcagatggaggggtaggattcaaacccagaattcttagccagtacctggcagttcttccacaatcttaacaattaccctccaccaccccttgggccctctgtccccaggagcccggccagccaagactcacatcctcaggcgagtggcaaccaccagaagtggttgtctcagggttagtgccattatttattttcttctttttggtgtcgcttgctgctgtaccaacactagggttggtctggggatgatggtctgtcaactgtggaaaggaagagcagtgatactcatgagaactacaagctcctacagtcacatcctgctttacagtttatactaaatactcttatagaccatctgatttaatgccaccaactgtaggaaatgttgtcacaatcacttagtgactgagagagattgataccatggctgaaaaaaaaggcagtaatggaacttaaactcagtcttctgactctgagctctgggattttgccctaaatcagcagctgccagggaccaaaaccagaggcagaggtagaaaagcaaatattaagtaggcaggaactgtgcactatgtggtttagggttattcaccctcacacgtctgttagtgttaaaaagtacaccagtacctctcaaacctttacatcaatgtctcctcatggcagaaggcagcctttctgctaaatctgggaatttaacagaaagaggacaacccaagcctcatttcagagagaagtcttgtatacgcttataaatctatgtgactttcatccctaagtacattaatgttttgtctctcaatagaatcaagggaaactgatgcttcagaaagatgccccatatttatcctgtggcactcaaagtaccccaggttgagatgagatgaggaagactcaagctaagttcagtttcccaagatctgttccacagaagataagcagatctcactccagaaccagtgactgaggggcactctggtcccagaacaatggagaattcaaatctgaggtgcagaactgagaaaaaatgttaaaatctctctggagagtagaagcctgggagaaaaccaaaccaaacccgttctcccattgccacccagagacactgtcaacgtgttgagctcctgggggaggtgtaggcttttcacactgtcaaggtctgtggtaaggaagtcaggcagcctgaaacctctctcttctaggtcccacagtccccattccccttccagctggaaacctgtgctgcaaccagaggaaacagaagtgggcaagaacacttaggggactgggtcctaagaccaaaggccggtcttgtggtagtaatgacagtttgtagcgggactgtgacatcactacattctactcctcggtggagtggttgggggggacacatgagtgcaatgcccaagttgccgctttgagactggggagggggtcacaaaattgggagccaggtccttggagacgtgaccccaaagagccccgggaggtcaggcttggggcggcaggaggtgagggccaattaaggagcaaggagctccaggagtcacatccccaaagtcaccctgtggcaactggtgagggcaggttctggggcacccaggtccttggagctgtgagctcaaggagcccagggaggtcgggtttggggtagcaggaggtaagggcggagtatggagttggaagccccaggagtcacctgctcaaagtcaccctggtgtgccgggcagagcaggggcaggacttatgagggggttgggctggctgacaagattttggtgtggggagcccagaggcactggggtggggggcccagcctggtgtccctcaggagtggcacagactctggcagcagttcggctgtcagagggggcctcgggttgggttggggtgttggtgcgtttacctgttccttggcctcggccaatttgctctgtctggtttctttggacatcataggatgggtagggaggtggggatgggtagggaggtggggatgggtagggaggtggggatgggtagggaggtggggttggggccacatcagcatgatccaggtgaggacaagtatatacctccagtcacctctacgtcgctgtgtgactgagccagaggaggcgtaaccagggctgcactagaatgcagaataggggtgtggccttcatgcttgaagcccattggtcaatgagaaagatgaaaggaaaaggaggtgtggccagacagcagcgtgtcatcaaggacctgtgttgtcacaaggaaagctgcctatgcaaccgctgtccccgcccactccaggagaggggcggggctggctttcactttaaaaactttaaaactttattacctcaattgaggtacaagtcctattaaaatggaaattttatagtgtgcttgatgattgataaagcagactttattatccaacattccaataagataatcacaatgttttctcttttttggaaaaactttctcttattctcctacattagcgtttagttttttttaaaaaaacaaacaaacaagaaacatgtctaatatctttaaaaatacaaagctttgagccaggcatgatggctcatgcctgtaatcccagcactttgggaggctggggcgggtggatcacccgaattcaggagttcaagaccagcctggccaacatgatgaaatcctgtctctactaaaaatacaaaagtagctgggcatggtggcaggtgcctgtaatcctagctacttgggaggctgaggcaggagaatcccttgaacctgtgaggcagaggttgcagtgagccaaaatcatgccactgcacttcagcctgggctgctacagaatgtgactctgtctctaaatacacacacacacacacacacgcacagacacacacacacacacacacacacaaggctttccatttaataagcactcaaagttctttacaaggttaaagcaaatacaggacccttctaaagtaaggctaaatgctaagtgatgggggagagaaaaaggacataaataactcctactctcatgagttaatcactaaatccgatttttctagaatcacctggcctctaagccctgaaaatgaaactgaatttctcactcgatacttggctatgacttgcaatcataaaaaccaagaattgtgttatgtcactgtgtattgcttgttacctgggatcaagggttgactttttcatgatttgctccattacctgtgtgcttcttctcccagtccaaactacgcttttttctagagatctacaatttacagttagtatgtaagggtggctctcaaacatgtagtctccggaccaggagcacctgggaacttcttataaatgtaaattctcaggccccaccctagacatgaatgaatcagaaactctgcagtagggcccagcaatccgtgctgcaataatccctccaggtgctcaggaacctctgccatacagcaggtagaaaaatgtgtttccttctgtagggccacagccagggatactatacgttctgtctcaatatgaaacaatgacatgcaattaaaagacataaatctccttcctacttccaccctccagccagtgtgttttatttttatgagttcaataagaaaacgtgtggcaatcagagatttcatctaaaaaatatatctacaggtatcagttctcatccagcctgatctcatccaatatcatttctatcctcttacatctaaagttttagaaaaggattttcacaacgtaagactcaggcgcactaggagttctatgataaaagaccaagtagatctgaatgtccaaacttactagagaagaaaagtggactcattggctatattttcaaattgcattcaacaggaaattaaaggtttgaattttttccaccttcatccttccaagttaatagaattaaaccagaatactccattcttccaaagcctgtagccaggcaaacttttactgtattacttcttgcttttcaatggatataaagcagagtcctggtaggcacattttgtatacctgcaaagatgcaaaactaaacagttccctcggttcaatattaaaacaaaagtcctgtaaacctcagatggtgagtgtaatacttcagcactagcacgaaagcctcaaatataaaaagataccaagaaccttgctagcaaaccaaagtaagctcttggccgggagcagtagttcacgcccgtactcccagcatattggcaagctaaggtggggtaagtcaggagttaaagaccagcctgggcagcatagcgaattcatatctctacaaagaaaatttaaaaattagctgggcttggcggcacacacctgtagtcctagagctacttgggaggctgaggtgggaaaatcacttgagcccagaagtttgaggctgcagtagctatgatcatgccactgcactccagttggggtgacagagcgagatctaattattacattctctcctgctcctgtttccactaaaatcactaacttaaaatgtgttcattcagcaggataaaaattaagtgaaatttgactttggtgctttgctagcaaaaaataaataaagtgaaatgacaaattacttactgggagaagatctttgtaacctcaatgacagattaaaggtttgtatccttagcctataaagaaatctttaaaattactcagaaaaaaaaatgaatgatttgcagcagaaaatgggcaatggagaaaccagcacttcccacaagaataaaaatggccaatgagcaaatgaaaaagattcaaaagcactagaaatcaaagaaaggtaatgaaaacaatgagattttctgcttaaagaccagcgaagacgacaaatggaagggggaacctggagctctgtccctgttggtgggagcataaactcaaccaattttcctataggatgatttgaacatttcttttaaaaatcctaaaacggttttatattattttcttctagaaattctacttctatgaattcagtgcaaaaatcctcactcgagtccattaaaatatatatagaaggaaatccacctctggggtggcaatgattcacttaacatacatccagctgttgaaagtgatgatgccagggtatatttctccatagaaacatgcttaaaatatagtaagtgacaaaagaccatgtattgtgattctactttttaaaatgtttacagcataaaaagtgtgaaaagcaacaaaccggaatgttttgagtggcaaaattaaagatttttctttacattttgtcatccaaattattacaaaaacaatgtgatttcctttataatcatggaaaagtgttattttcatttatttatatttacatttcttttctttttcttcttttttctcctgtatgtatcccacataggctacagagcttaaatccctgcctcttgagagaaatcagcccattttcaggacatgcaatacacaaagctgccccatcttccctttatttttatttttatcttatttatttatttatttatttatgttgagatggagtctcactctgttgcccaggctggagtgcggtggtgcatctcagctcactgcaacctccatatcccgagatcaagcgattcccctgcctcagcttcccgagtacctgggactataggcatgcaccaccatgcccagctaatttttgtatttttagtagagaggaagttttaccatcttggacaggctggtctcgaactcctgacctcaagtgatccgtctgccttggcctcccaaagtgctgggattacaggcatgagccactgtgcctggcctgtcatattatttctaacatttgagggacatttcaattaagtgaaatttaattcttactgacctgatctcttatcctctgtttaatgataccttccagttgaaaggtgtttcctctgtaatcacgggtgccaaaggaaatacaacatgtattcattaggtggatatccactaaaccacggattcatgcattgtagtccttagaccctcagcatcagaaacacgtgggaacttgttagacatgcaaattcctgggccagccccacacctcctgaatcagaaagtggggaaggacagctatctgtgctttaataagccttgagatgctccctgaagtttgaaaactacagaactagaatacatatggtagtaagtgctcatactttatccaaggtactagggactcttcccctcttttccattctcttttctgttgaaataaaatgagagctccttttgacttaatgggtataagaaagaaggcaatgagatgaccagggtttcaagttagagttcaaaatttaatcagtggacagtgacaggatgcaagccttctaaacagattgctgcaaggaagctgattataatctatacagtaggtatcattagtgtattgatgttaaattttgggggtggattaatggtattgtgattatataggagaagtcctggttcctagaagatatctgcgaaagtacttaacagtgaaatgctctgatactgccaacttactttgaaatgattcagagggaaaaagggcacatatacaatcttccatacgcagaagacagaaaacaagtgtgacaaaacattaactagtgaatccagttgaatagcatacagatgttcactgtatgattttatcaacttttctgtgtttgcaagttttcaaaataaaagttgagggaaagaaacatcaccccaaatctttctatgaaatgggaccatagaaaaagcagagaagtgaacactttgcagaaaagagcactgcacccatccggacagcatggtcaaagtgcaggctctcctccaggaggctcttctctggtctcttctgtgctgtcacttcccccacatgcagccaaggcttttttctaacaactctttttctaaagatgtaatttttgtcattcatctaagaaagagaagaaaagaattagtatacatttagaaaataaaattacacttacatttgtgaaaaagcaaaaaatactttgaaaagtggggaagcaagaaatgtactgttctacaattctgttctgttcttaccatctttttattctgccaatgacttcctattcctgctgtgtatggtggggtgagctgcaaatgatttcttttcctcattgatttaaaatctcatgtttataatgtgccaaactcccccagaagcatttgggtttatttctgggctctattctattcaagtaatctatctgttcacaagccactatcagttttgattattggagcatcctaaagttaagtaattgttgtttttgtttttgagatgcagtctctcactctgccgcccagctggactgcagtggcgtgatctaggctcactgcaagctccacctcccgggttcatggcattctcctgcctcagcctcccgagtagctgggactacaggcacctgccaccacgcctggctaattttttgtatgtttagtagagatggggtttcaccttgttagccaggatggtctcgatctcctgacctcgtgatccgcctgcctcggcctcccaaagtgctgggattacaggcgtgagccaccgcgcctggccctgaatttgcttgagtttttagctctctcacccatttcaggattgtcaccacccatatctgacacgtcctcctcctcctctaaatcttctaggtcctcctggccatcagcctctgtttctgaaccagcctcttcatgctcctgttcttcactctctgggagaagactgatatcttcatctttctttcactaaccgcattctggaagcacggtaaaattgcttcattttgcaattccagttgttgcaaagtctgctcatcatcaaaactttctatcacaagtttttgtaaagagctgccatggattctaccattctctactgttttattaaagtcataaagcacttttgttaaagaagtgaactttggttccaatccatcttgaaacctattgggaggaattaaatgagatttagaattatagataataatttcacagccctcttaattaaaagaaaaataaaaacctcaactcttctgtaaaatcaaatttgaataaagtgtaagtatagattctggccccaacaatatataagctgatgagccacaatgatatataaaacctgtcaaccaagtatttgtgaatcagctgtatagattgttggcaggaaaagcattacaaatctatttgcttggagatatatagtgaattagccttaaattatctactctgctacattatataccactccattcattcattcccttattcactcaatgatcaacatttgctttggctacagtggtcaaggaaaacctctcctagatgtgacatctgagatgaaacttacagacaagtatagtcttataaagattgggaaacatgtattccaggcggaagaaacagcaagaacaaattctctaagatgcaattgagcttggtaagcctgaggaataaaaaagtgagcatggctatagcgtgaaggaggcagaaggtgaagttggagagactgatgggagccaaattctgcagggctcaagggtaagagtttgccgttttaagtgtaataagaaaatgtgagaagattttaagcagaaggatgaaatgatgatttatacgaaggaagaagaaagggaggaaggaggaggaggaaagtagagtgattagaaggttgatgcagcattccaggcaaaagatgatggtgatttaagctggagttagagcagtgaatatgctgagtacagtttggaggtagaactgacaggattgctaaggaattagatacagaatagagaaaagtgaagtcatcaaaatagcagcctagttttatgtgcgagcaactggagagacagaactgccatttactgtgataggcaaggcttgagtggtggagcaaggggaaaggacttcagcggatggcagagtgtaggtgggtagaaacaacattctactgtattttggacacagtgaatttgtgatgctgagaggaccaaaatttaaaaaattgttaaaagccgtacggtgcagatatcccagttgtgcgctactgaattccaactaagctcagtctggagttgcttgtgagcaaggaactcaagggagaggttggagtttgaaacataaatgagtcataattttataggtcatatttgaagttcttcaacaaaatacacataaaacgtttgtgttgggaagagacatgaaagttctaattctcaagaagcttagtggggtagacagacaagtgacaagtttgtgctttcaataaagtatgatggcaggtaaacactgagtgctttaggagcacaggcggaaggagaaaccaacacagttgtgtgtagggggatgggggccgtaataagcctcaaggggagcttataggcgtgaataactgaggttaggttgatttcaataacattcaactgagagatccatactgtaaaagttttaacaatttttaaaattttgatagcctaggtcctctgaaatgtggggaaaagtgatttacatttccccttaccttcccccagctccacaatttgccaggggtctgcaacccgtgtccacgtgcgaccgcagtcgcacccgagcccgggatctgtgcacttacgtgaggatgcactcgggccagccagtggctttgcccacctccctcagacaccgctccggggtccgtcagcgccaggcccatgggccatggctgtctgcaactcccgacacaagctgcaaggcaagagagccgctgggaaaccgcaccgcaaggatgctggcattggaacaggaattaaaagaaatgaaaaaatgtgtaagcaaaaactcagctgtatgtaaaaaaaacccaattccccctgagaatgagaaagagccttagtcctttaaaaaaactacctgttttcctatggctagtgagccttatcgctcccttcccaggcattatcaaaaccctaattccctaactgtgcaactgcaaggtcactaaacaaacaaatgcaagtcacaaaacatatttttcctaaaaacgtaaaaaaaaaaaaaacataatgcgtgcttcaattaaataaccctctgtttctcgcttctgtaatatgcttccccctgcacagatctacccgggctccacaaaatgctaaaagataactctttattcagctcaacgctttgatctgcctggcgtggtggctcactcttgtgatcccaggactttggacggccaagtagggtggatcgcttgtgccttggagttccagacaggcctgggcaacatggtgaaacctggtctttttgttttgtgttgttttgagacggagtttcgctcttgttgcccaggctggaatgcagtggctgggtctctgcttgccgcgacttccgcctcccgggtttcggtcgttgtcctgcatcagcctccagagtggctgggattgcaggcataagccaccaagcccggctaattttgtatttttttttttatttttattttggtacagatggggtttctccctgttggtcaggctggtctgaaactcccgacctcaggtgatccacctgcctaggcctcctgaggtgctaggattgcaggcttgagccaccgctcccggcccaatttgttaatcagaaaggaatagatcgtcctggtgtggtggctcacgcttgtgatcccagtactttggatggcccagcgcggggtatcccttgagcctaggagttccagacctgcctgggcaacatggtgaaacccggtctctctctctctctctctctttttttttatgaggtggagtttcgctcttgttgcccagggtggagtgcagtggctgggtctccgctcacagcgacttctgcctccagggttttagtagttctcctgcctcagtctccggagtggctgggattgcaggcctgaccaacattgctctgctaatttttttttatttgtttttggtagagacggggtttctccatgctgggcaagctgatctcaaactccagacctcaggttatccgcccacctcggcctccggggatgctggaattgcaggcgtgagccagcgcacacacccaatttatttttatttcattttttatttttatatatatatacttttgagacggagtctcactttgtcacccaggctggagtgcagtggtgcgctgtctcggctcactgcaacctctgcctcccaggttcaagcgattctcctgcctcagccgcctgagtagctgagattacaggcgcccgctagcacacccatctaattttttttttttttttttgtatttttagtagagatgggttttcatcatgttggccaggctggtctcgaactccggacctcaggtaaacccacctcggcctcccaaagtgctgggatgacaggaaggatcggcctggcgtggtggctcacgcttttgatcccaggagtttggacgggccgagcgtggcggatcccttgatcctaggagttctagaccagcctgggcaacatggtgaaaaccggtctctctctctctctttttttttttgaggcgtagtttccctcttgttgcagggctggagtgcagtggtgcggtgtcggctccccgcggcctctgcctctgggtttgggtggttctcctgcctcagcctccgagtgactgggattgcaggcgggagccaccatgcccggctcttttttttttttttttttttttttttttctggtagagacaggtctctccatgttggtcaggctggtctcaaactcccgacctcaggtgatccgcccaccacggcctcccggggtgctgggactgcaggcgtgagccaccgctcctggcccaatttattaatcagaaagaaatagatcggcctggcgtggtggctcacgcttttgatcccaggactttggacaaccgagcgtggggaattgcttgagcctaagagttccagacctgcctgggcaacatggtgaaaatctgtctcttattattattattatttttttttgaggcggagtttccctcttgttgcccaggctggagtgcagtggctgggtctccgctcgcggcgaattctgcatcccgggttttggtggttctcctgcctcagcctcctgagtagctgggattacaggcacctgccgccacacccggctaattttttttttttgtatttttagtagagacgggttttcatcatgttggccaggctggtctcaaattcctgacctccggtgatccacccacctccgcctccccaagtgctgggatgacaggcgtgatcggcctggcgtggtggctcacgcttttgattccaggactttggactggccaagcgtgggggattgcttgagcctaggagttccagaccggcctgggcaacatggttaaacccagtctttttttaaattcctttattattattattattattattttttttgagacggagtctctctgttgcccaggctggagtgcagtggcgctatctcggctcactgcagcctctgcctcccagggtcaagggattctcctgcctcagcctcctgagtagctgggattacaggcgcccaccaccacacctggctaatttttttttattttttagtagatcgtggtaactgccttaaaatgatgattgttcagaaagtcagtttaatttagatactaaggatattgaggttatgtaacatttgagcaagttctaaaaaaaaagagaaatagtatatttaattgctaataaagtattgtcaactcacaaatatattcacatagcatacatttcaagagcagaataaccatgaatataaaaggaattagcaaaaacgagacaaaaaagacatgaagaaataaaaacagatggaacaaatagcacaaaatacgatgaaagttataaaagaaactatgccaacaatcacaataaatgtaaatagactgaataattaagagaaaatgactataaaacagaattagggcacgcgtggtggctcatgcctgtaatcccagcactttgggaggatgaggcaggcggagggatcacaaggtcaggagttcgagagcagcctgaccaacatggtgaaaccccatctctgctaatacaaaaattagccggcgtggtggtgaacatctgtaatcccagttactcaggaggctgaggcaggagaatcgcttgaatccaggaggcagaggttgcagtgccgagatcacaccattacactccagcctgggcaacagagcaagactccgtatcaaaaaaaaaaaacacacaaaaaaaacacaaaaaacagaaaataaacagtatgaaaagacatctaaaacataaagtcacagaaagactgagagagattgaaaaaagatacacatgtcatatgtacctaacccaaagaagggttggaagctatattattatcagataaaataggctttgggcaaaaagcaatatgggagattttttaaggtcacaatatgatgataaaaattctaataaaccaagggagaaggtaatctaaaatgttaatgtatctaataactagcactcaaaatacatgaaagcaaaatatgacaaaattgcaaccctcagagggcaatttaaatacatatctcagtatctgataaaagagacaaaaaacaatcagcatagacatagaagatttacatctctctagaaaattaacaagcttgacctaatgtagagaaaaaacatatctctccaaagtgacagcattcaccccccccaagtacatatgtactgagccataaggaaaatctcaacaaattccaaagaagcggaatcatgcatccatctttctctctaaccataatctcattaaactaaaaacaataataaaaagataaagtaaaaagccagaaaggcagatgctaaatgagaaagtgacagaaaagttacagattttgttaagcatacaaagcttctatagggtaaagcagtcaaagggatatgcaaatttacacagaaatccaaccgatataaatccttgaaagatactacatacagatatttcatcagttctcacatgccaaacccagcaaagccaaactttggagcctcccctgcgagcagacctgccacaggaggagaggcagcacaaacctccctttgcagtgaaaatgccacattgtgtgtgcttcttaccccatcacctctttggaagtggccccactcagtgctagctgagaatcgcttccctcataccactctcagtagttcaccccaagacacactggacaactctgtacctggtaagtcattgtgaatccaattaataatggcattcagaaagttaggaatctttgaattattagattcatagtgatattcaaaagaaagaaaacgacatcatttctgttccacgcatgttgcccacattcactgcgtaaaaggcaaagggaactgtgagtacccacaaagaacctgatattgacggcacatacatttcttcattaggaagaataaatttagactgtaacaatttaaaaaaccagaaaatacaactgtacattttagctcttattaaaatccaagaggtttaacttatttgctccttgtttaggtaattagtgtctaaaacatttcaaagataacatatatagtggctacgatttctagtactttttaaaaattcaagcccagtctcttctaattaaatgtataaatgatttatctctgtctttcttaaaaagaaccaagagccccaattaaaaagtaaaacttaaatttcctcttaaaaaattgttacgtcaaaattatcgaataaaccatagttcagaaaataatttctgaattaagaaaatatgaataataaaaccaacagttcatgtgctgaatttcaaatttttattttttattatttttaaaattttgttttaagttctagggtacatgtgcaggagtgttacgtagggaaacgtgtgccatggtggtttggtccacctatcaactcatcacctcagtgttaagcccagcacgcattagctatttttcctgatgctcctcccccacccgccctgacaggccccagtatgtgttgtttcccttcctgtgtccatgtgttctcactgaacctcacatttttaaatacagcatatgccaggtgtcatttcagtacccatgattatacatagtataattatacatagtatatgtatatgtgtaaatatatgtatatgtgtacatatatgtatgtaatatgtgtatgtaaatattatgtaaatatgtatgtatgtaagtatatatgtaaatatgtatgtgaatgtatgtaaatatatacacatgtaaatatgtatggaaaaatatgtatgtaaatatatgtatgtaaatatatgtatatatataaatgtaaaatatgtaaatatttgtaaatgtaaaatatgtaaatgtaaaataaatgtagaatgtcaaatgtaaatgtaaaatgtaaaataaatgtaaaatgtaaaataaatgtaaaatgtaaaataaatgtaaaatgtaaatgtaaaatatgtaaatatatgtatatgtgtaaatatatgtgtgtaaatatatatgtatatgtgtaatatatatgtatatgtgtaaatatatatgtatatataacacagcatacagcatatgccaggtgtcatttcagtacccataattatacatagtataattagactactatgttagctaaaaaatgttgattagatacaaatgtataaatttatcttctctaaaagtggaaattctctagaggctatttccagcttctgtgtggattgtagagcaggctgctacctgtaccccaaaaatgaacaccttaaaaaaaagacaagtttctcagcctccctattgcacacacatatgaaaaatatgttaaattcaacgccaaatattcctgagatcaacacagcagtgatcccaaagagaaaatttctctttgctaatgggcacaaacttgaagggcaaagcagtggaagggtaagtctgcagactcgggtggggctcaagtcagaatcacgtggaagatcattgccacatgtttttgtttttttaaatagcaaacaccaccaagtggagcccgccgggtttagtagatattaaacctctaaggagtggcacatccgagactgaaattcccatcttttgattcccagctcaaggtctctgaaatgccagcaccagctgtgaaattgttcttctgcattttcatggagaccttttcttctatactgccatactcttttttttggaacagttatacctgatcttcctatttttgtgtgtgttccaccgaaagtttttcactctaaatacttccctctttccaactgagcatttacatctgtaacaaggacaaaaacatctaacatctctctcacccttggtttgtgttttgttttgtttgtttttgagacagggtcttgctctgtcacccaggctggagtgcagtggcgtgatcaccgttcactgcagcctcgagctcctgagctgaagcaattttcccacctcaacctctgagtagctgagactataggtgtgtgccaccacgcctggctaatatttgtattttttgtagagatgagtttttgccatgttgcccaggctggtattgaactcctggcttaagtgatcctcctgcctaggcttcccaaagtgctggaaggaattacaggtatgagccaccgtgcctggcctcaccattgttaaaattatggaaatcgtgtttgcaaagcagcttggcctgtttggaaaagggtgtcataatttctcaggtaactccaaaaagagaaagctacgaaaattactttaatacattcattacagtcccagtataagattatagcttcctctcccaaagtgtaaccacaacctgacgcaggatgagttggtttgaaaataccgcatacaatatcctcttgagtagaatcataatttagaactctaaaattgaccagaaacaaaactgtccaagtttgtttaacgtaatgtgtttcaacttatttgactagaaaacccttcattcgtgcaacacttataaatatcccatggcaaatctagttttctatgaataatgaacaaaacatttataatttaaaactaaaattgtcttctaagcagagatctacgtatcaataaaatgaagaaataaaatttccatactgttttcttcccaatacaaggattagaaggaaagggaaaagagtaacagcgagaatcaatagcccatgtctggccaggctccatggctcaatcacacctgtaatcccagcaatttcagaagctgaggcgggaggatcactggcctttagtgatccttgaatgaaactccatctctaaaaaattaaaaatattagcttagagaatcatttgggcccaggagtttgaggctgtattgaactatgactatgctactgcattgcagcctgggcaacaggctgcttaaacctggaggggcggagcttgaagtgagccgagatcgcgccactgcactccagcctgagcaaaggagccagactccgtggcaaaaaaaaaaaaaaaaaagagattctattcacaatagcaacaaaaccctgagaatatatctagcaaagtatacacaaggcctttcatgaagagtattgccatagcctgaatgtgtctcccaaaattcatgtattaaaacttaattcccaagatgatagtactaagaagtggggcctttaagaagtgattaagacatagggtgagccctcatgcatgagattagtgccttccttataaaagggcttgtgggtggtggtaaatctgtcccttctgcctcatgagaacatagcatttgcctgctccagaggaagcagcattcaacgtaccatcttggaagcagagaccaggccctcactagacactgtgtctgctggagtcttgatcttgttcttcccaacctccagaactgagaaaataaacttctgctctgtgtaaattacccagtctcaggtgttttgttatagcactatgaagggactaagacaaatataaaaattacccagggacttaaaggaagaactgactaaactgaaatacatgccatatatattatgaatcgtaggactcaatgctataaacatactacttctcaacaaattaatctataaattcaagaaattcctacacaaatcccaatagaatttttttgtggaactcgagaggctgatcctaaaattcatacagtcacttgaggggccaagaatagtgtaacagggctggcggggctggtggctcacacctgtagtcccagtacttgggaagtcaagactggaggatggtttgaacccaggagttcaagaccagcctaggcaacatagcaagatgttgtctcaaaatattaaaaataaataaataaataaaaagaaggttaagtatgcacattttgttgtgaatttcaattttatagtgatttttttttttttttgagacagggtcttgctctgtcacccaggctggagtgcagtggtgccatcttggttcactgcaacctctgcgtgggctcaagcaatcctcccgcctcactctctggagtagctgggaccacagttatgtgccaccacacctgactaatttttatattttttttttgtagagacggggtttttccatgttgcccaggttgttctcaaactcatccacctgccttggcctccgtaagtgagatcacagacatgggccactgtgcccggtctagtgcgctttttttttttttttttttttttaaccaaacaaacgatgaagtctcaggagtaaaagttgatacacaagtaaattttattggtaatgtttttgtgtggtctttaagcagagggaaaattagtctgcattatggtgtatccagactaaataactgatattaaaatgaaattatccttaggatttgcaatcttagagaaaactttttcattttttttgagttacaaattatcttcacttacatttgagaacagtgagtcacagagggattaagtatcttactcaagatcttgcaagtgtttggtttgaacccaatcttttcactctgcagaactcagagtcactcttatttggaaactttttaactgatgtggatcctctaatatgggcttcctattattcattccgtattagtcagaagttttgcaagcaggcagaattcattttgccaattacgggattttccctcagttgcagtcaaggttcataaaactataactatttatctttaattataaattttgtttttgagacaaagtcttgctctgttgctcagactgggatccagtggcacagtaacagcccattgcagctttgaactcctgggctcaagggatcctccgcctcagcctcccaagtatctgggactacaagtgcatgccatcatccctggctaattttgttaaaaaaaaaaaattgtagagatagggtcttgcttcgttgcccaggctggtctcaaactcctggcctcaagcaagccttcagccttggtctcccaaagggctgagattacaggtgtcagccattgcacctggccaaaactgtaactatatatacacacacacataactacatatatatgtgtgtgtgtgtgtgtgtatgtatgtgtgtgtgtatatatatttttatatataaatagatatatctgaaaggcatcaaaagaaaaaagctgtaacttttagtcttgatcttgatagtgacttgattaggctatctgtttaacatcaaagatgcaaattaatgctttctttgggtgagcatattaaaaatgcagaaaatattggagtagttttttatgttaaataaattgtattctgtgtatttaaggtatacaacatgattttatgggatgcatatagatggttaaaaaaaattactacagtgaagcaaattaacgtatccttcaactcagatagttacccgttttctttttgtttggtggcaagaggagcttaaaatctcatttagcgtgaatcccaaatacagcacaattttattacctatatttctcgcgttgtacattatatttctaggcttgttcatcctacatatctgctactgtgtaacctctgagctatgtccacccattttctctcttgccccccaagtaatttcctaaagtgtctcatataaaaaggcagtagctttcagcttaaactttttctctgtatatatttaagtcaatttctttgaggtatgtttttctctccagaatagttagatgtaggcataccactttaatgttgacactagttcacctagaacttatcttctgcaaatctgtctctatgtccatctctgtctccatctttgtctctgtctttatctctgtctatctatctatccatccatccatccatccatctatctctctatccatctatctgtctatctaactaaagcaaattcatgcccttctcctatttatggaatcgagaccataaacagaggtgagggaaagaatttggcaggaattgcgatgtgtattacctgtggcataaggaaactttacagaactagggtcaaaagtatactttctagttctttcccatggcttttcactttgatgtagtccttatcaggcaactgaggttttatataagtcccctgattcttagaacatgaaggtgtagtattcaagtttggtcccttgaaaccacaatttttgttaaaaaaaattaagaaaattgtataatttcctcagcaaatacatattgatcatctgttatacagccatgagaagtggttctgttgaacacgtttattttatcagatcccaattctaaaccaggcatagaatggaaaccatgaaggtaggatgaaataacttctgaatgtttgaaaatagtgtacttaaaaataaatatcaggtgtttttgttttgttttttgttttttgtttttgagacagggtctcactctgtcacccaggctggagtgtggtggtgccatctcacctcattgcagccttgacctcccaggctcgggtgatctcccacctcagcctcccaagtagctgggactacaggcacatgccaccatgcccagctaattttttgtattttttgtagagacagggtttcaccatgttgcccaagctggtctagaactcctgggcttaagcgatcttcccacctcagcctcccaaagtgccaggattacaggcatgagccaccatgcctggctgaaaataccaggtttttaagtatcagcactgcctcttcaatcttttctattactatgttgtgctcagtggtattttttattgaattagagcagtgctgttcaatggaaccttctttgaggatggaaatcttttatgtctctgctgtgtgggtatggtattagctgggtatggggcacctgcctatagtcccagctactcaagaggctgaggtgggaggatcacttgagcccaggaggccgagtctgcaggttcgtaccactgcaattcagcctgtgtgacagaatgagactcagtctcagaataaaatgaaataaggaaataaaaatgtaattgttgaaataagaaactagtggatggattagacacgagaagaaagaattaattgtttaggcgattctctccaaaaagtaagtcagcatgtcacacagagagacatgaggatggatgatagggcagaagttggtgggcttggaggggagaggaagatcagaatgaggtccaaaatgtgtcttagtgaaatcccaggaggagatattaaaattatattagaaagtgaaagaaatagaagttttatttatttatttatttatttattttgagaaggagtctcgctctgtagcccaggctcgagtgcagtggcacgatctgagctcactgcaagctccacctcctgggttcacgccattctcctgcctcagcttcccaagtagctgggactacaggcacccaccaccacgcctggctaattttttgtatttttagtagagatgtggtttcacctttttagtcaggatggtctcaatctcctgacctcatgatccgccagcctcaggctcctaaagtgctggaattatacgcataagccactgcacccggcccaaaagctttgtgtttttacaaatattacacatgtttcttgtttaagaaaaaaagtcttcacaataacgtaggagaataagagaaacatttttccaaaaaagagaagtcattgtgattattttatcttattggaatgttggataatatagtctgcttcagtaatcatcaagcatgctatggattttccattttcataggatctgtatctcggttaaggtaatactggtaatttttgtactctatgaaaaatataggccaaaatcatagaccttgcatagaagctggatcatgaagacagctctggaggaacacacaggtacacacacacagacacacatatatataaagtatacacatatatatatttttaaaagcttttaaagcaaaagccggccctgcccctctcccagagttggcggcctctcccctctcttagggtgggtggggacagtggttgcctgggcagctttccttgtgagccaaaggtccctctggacacatgatgcctggccacgccccctttccctttcatctttctcattaaccaatgggcttggagcattaaggccacgcccctattctgccttctactgcatccctggttacgcctcctctggctcagtcgcacagctacctggtaggtgactggaggtgttgatcagtgcttggtgggattttgctgatgtggccccaagcccgcctccctccccaccctgcgatggcagaagaaactcgacaaagtaaattggcagcagccaagagaaaggtaaaaacacaccaggtcacggacccccaacccagccatagatcctctccaacgacaagactgctgccagagtccataccactcccgaggttcaccggactgggacccccacaccggtgcctctgggctacccccaccaaagttttgtcagtcagccccaccccttcagcaagcagcccagtctctgccctcaccaatcaccccagggtgactttgggcaggtgaatcctggggctccccgctcctttactgggcccccatctcctgccaccccaagcttgacctcccagggctttttgggctcacatctccaaggacctgggtcccacagccccagaccccaccctcaccagtcatccctgggtgactttaggctggtgaatcctggggctccctgctgctgactcttcccttccctcctgctgcctcaaggtggacctccctaggctgtgtgcactggtgtctccaaggacctgggtcccagctctgtttttccctcccctatcatggagcggtgactcggacatcatgctgatgtggtccctccccctcaccaggaagagtggaatgtagtgatgtcacggtccatccagtaactgtcattactgcaagactggcctttgatcttatgacccagtcccctaagcattgccaccccatttctggttcctcttgtcacagcacaaatttccagctggaaggggaatggagattgggacctaggagcaagaggtttcaggctgcctcactcccttaacataaacattgacagcgggaaaagcctacacttcccctgtgagctcaaaacattgacagtacctctggatggcaactggagaatgggtttgacttggtttggttttctcccaggcttctactttccagagagattttaacaaattttttgtgagttctccacctcacattctaattctccatggttctgggaccagactgcccttcagccagtggtctgtgaagtgagatttgctcatcttctgtggaatagatcttgggaaactgaacttgacagcttgaatcttcctcatattatgtaaacctggggtactttgagtgccacaggatacatatgggacatctttctgaagcatcagtttccattgattctcttgagatcaagagaaaaaacattaatgtacttagggatgacagtcacataggtttctaagagtataccagacttctctctgaaatgaggcttgggttgtcctctttctgataaattcccagatttaacagaaaggctgccttctgccatgaggacacattgatataagagtttgagaggtactggtgcacttcttcacactaacagacgtgtgaggatgtatgactaaaccacatggcatacagttcctgcctacttaatgtttacttttctacctctgcctctggttttggtccctggcagctgctgattcttggtaaaaccccagagtttggagtcagaagactgagtttcaaagttcgtctgtcgcctttttcttttcttctttttttttctagccatgatatcaatctctttgagtcactaaatgattgtgacaacaccttgtacagttgttggtatcattaaatcagatggtgtataagagtattttataaaaactgtaaaggaggatgtggctgcaggggctgatagttctcatgagtattactgctcttgtttctgacagttaaaagaatattggcagagaaacagccctggtgttccagcaggagccaagaggaacaggaaaacaaatggcagcatccatgagacagccacttctggtggttgccactcacctggagatgtgagtcttggctgactaggttcctggggacaggggacccaaggggcactagagggtaattgttaagattgtggatggactgttgggtacctgtgaagaattctgggtttgaatcctgcctctttgtctgctagggatatgaattagggcaagttgctagacctcatcgggcctctcttttcacatctgtataatagaggtggtattgtttcacttccatttgtgaagtttaaatgagatttgttattgttgtttttatgttaatccctagtacatggcctgctgtaaacacccagaacacccaggatatggtcattgctgttcgattttcctcatccccagtctcaaggggaagccaggacaatgagaacagtcacttggcacaggagtcactgaaagggccacagggtgctgtggtggggagataagaaccatgagagaagttggcacaaaggagttatgggacaaagggtccaagataggcagaaaagaaaattgtgccagttgatggggaagaaaagaagtcagagggcttagatactgagtgggacagaacatcttcatgtgcactctcatctcttgtagtcagcaacaggtatccacggggagagccctacatcatctgctaccctgaaggatctggaggtaagaggctctgggcagaggtgcagtgaccctgcaggccagccctccaacctcctcctccaggtgggacggggtgcccctctgccagctgagacagtccacacacaccccagccctaatgattgctctctctacctctccccccactcctcctccacctcctcctctctgcatgcgcctcagagcccgtgccaagaactagcagtagtcccagactcgaggtccgtaaaagtcagtcaactgaagaacaccatcaaatctttggtaagagtccactggggtcccctgattccacgctgccaatcctgggctctagtttccccttggggccctgaagaaaggggacggcggcccctggtgccaagggcgaatagggagctggggcgcccaggcctcacctggagggaccccggagcatgcagcatggctctttttttgctgccctgtttgctgactctcccctctccagacgcccctgctcgagtccttgctacacacgccctgggattgttgcctcttggggaagtgctagcctgactggttgtcaggggccccgtatttctgccatgactcagtccctaatttgctctttgattctggacaagccacctctcctttttgggctcatgtttccagaggaagtagtgagtatcaaaggtctctgttagctctcgagtctgagatttaaaggcctcctagaatggaaacctcagggccaaaggctcctgtctgtccttttccgccctaaatcttctgtgaagaaccgtacttggcccgtacgtgctcagtaaatgtttattgaatgaatgcacttttctaaatcacaagctggcagaagggggggcctttctcaaactccatctctagaggtttatgttactgtcctgtcaagagattccagattcagaccttgagttctgtggctgtggacaaaagccaacaaagacccaaatcctctgtccttgggagcttgaggagagtttaccagttcgagttcccactgggtctgagaactttgcctttaaaatccattcctggcccctgcctaccacttcctgctctggggaatagagttgagggggccaccctccatcaccttaatgtgactctccccacagaaacaacagaataaacaagtggaacatcagctggaagaagtaacatgatttctttgtttgctcgcgacatgactgctcggtttgggggacactcagatgtagaggccccgagtctcgtctcacccactcccagcctggggaagaaggctcaccccccagagtccaccccatcccccacagggtccctgataacccggtcccatgggtgggcctgtcccggggcaggggcagtggtggcattctggggacatgtctcttgcagtaccatctctgcctctgcctggttagatctctgtcttcctcttcctacaggaaaagaaagcaaacaacgagaaacagaaagccgaaagggagctagaggtgagtggacggtgtgcagttttctcctgtcctccggagaatgtttctttccttctctttcagcacttgcttggcttttctcccaaaggttcaaatccagagattgaacatacagaaagggaaactaaatacggacctgtaccacacgaaacgttctctcagatactttgaaggtgggaatctgggtaccctgtcatccttcaacctggcactttgacaggtcttcagggggagtcctttgggccccatctcaactctctcattacagaagagtccaaggatctggccgtccgtctgcaacattcattgcagcgtaaaggagagttagagcgggctctctctgctgtcaccgccacacagaagaagaaggcggagagggtgagtccaaccacctgccccgtcccctgggagcctggcttcgcagacagaggagtgagcctaaaggtcccttctgcaggatggagtgtcctgcccagaaggcagcatggccatttctcactgcttttttgtatggttgttagcggcagcttgggactgagtcagctgctgtgggtgagttggggggcactctggggagagagcacaggacgtagagcttggaggccaagtgcctgccatgcctttacctggctgtggtcttggccaagtcctcagtgggtattgggtacttgtactgtgaaggtacagaagagtacctttagtatgttaccatttctgtagagagaggaaacgtgtgtgtgtgtgtacatattatgataatatacataaaatatgtttgcaagtgttcataaaaactcaggagagagcaacagggtggctgggagatacttcccttctgtaccttctgagtttgggactatgtgaatgtattatcctttcaaaaagtgaacaaaagattaattttccccttcctagctgtgcccccacccccagcaagaaaaatgggcttagagaattggatagatctgggtgtttaaatcccagctctgcctaagtgatcttaggcaagcacttaacctcaaatactccatgttttttcatctacacaatagaggtcatcatagtaactgtctcccatggtagttgcgaggattaaatgggattgctagcatggtatctggtgaagcactccataaaagttcaaacagtggtaataataacagtaataacaatagcaatattatctgatctctctgggcctctgttagccagctataaattcgatctctttccctgtcccttccaactttactgagttctttaaaaaccaaaccacgggcttggaaatgccttgatctttactgaccgagttgtatattgggcctagccctggcccttttaaggggcactgtgtggaatggcccggcctcaccagattgaaacttctcactcttcagcagttctccagccgcagtaaagcacgtatggagtggaagttagagcagtccatgcgggagcaggcactgctgaaagcgcagctgacacaggtgaggtgttcagagggagggatgtggaaggaagatgaccccaggtaaccaggagcaggtgaggaccagtgacagcccttcctaatttctgtgcccattcttgcagttgaaggagtcacttaaagaagtccagctagagagggatgaatatgctgaacatctaaaaggagagagggcccggtggcagcagaggatgagaaaaatgtcgcaggaggtgagatctgacccttcagcccccccacattagataggtcactggatctttctgggcacctgtaaaatgggaatagtagagccagaggtggtcctgggactgggctttgtggaggtgggggcagagagggagatggtagcatgtccagcctccagcccctctctccagggccctttccccctgtgctttgggcaggtttgctcgttgaagaaggagaagaagcatgataaatatcgggtagagaagctggagaggagcttgtccaaactcaaacaccagatgggtaagatggggctggcgtgacctggcagcaggactggcatcagagggctgtgagggtggcttggagtgccccagcgaggtgggtggatggaagggctttgaggcagagggaaagaggtctgtgccaggagacggcaagtcttgtcatctcaatgagcctcagtgtccccatcagcaaagagggcccgttgtcagccacccgcagtgctctttctctgaaagtgctttggaagactggctaccatctgggtgcgaggaatcattagcagtgaggctaagtttgaggagccggagaggagctgtgcgccaagaggagggttttttcttttcttttcttttttttttttttttttggaatccagaggctcttattgtctgcttcctttctcagctgaacctctgcccccggagcccccagcagtgccctctgaggtggagctgcagcacctgaggaaggaactagagagagtggcaggagagctccaggcccaggtggagtacaatcagcgcataagtctcctgaatgaggggcaaaaggagaggcttcgggagcaggaggagaggcttcaggagcagcaggagaggcttccagagcaggaggagaggcttcagcagctggccgagccacagaacagcttcaaggagctggtgcgttgccccagctggggagcctgccctcctccctagccctccaggcctttgtttccccacctataaaatggggcagtgtagccctcaagtgaaatgttactcctaaaggcacctgtgagccagagccctgctctggtggctgtgggagacaggggatgatttttctaacctgcctccacccttcccggtgccatgggaggcagtcaccaagttctggggtctccagctgcagtgggtggctgctgattgcttctctctgtccagaacaatgagaacaagagcgtactacagttggagcagcaagtaaaggagctgcaggagaagctaggcaaggtgaaggagacggtaacctccaccccatccaagaaggtctgggaggtgggtgggcaccagcctctggggaggggaggtgccaggccagcggtagctccagcccgggggcaggtgaccccagcaccctccagggcagtcctgtggctgtttcttgcttcctgccctctgattttagaggtgggtagccctgggctcctcccaggtctggacatcatcattccagctagagacatggagcccccccaatcacaggggaagagacagagtggtataacagtcttcttatgccagatgcggtggcttacgcctatagtgccaacactttgggaggctgaggcaggagaatcacttgaggtttggagtttgagatcagcctggccaacatggtaaaacctcatctctactaaaattacaaaaacaaaaaacaaaaaaagaaagaaaaattagtggggcatggtggtggcgcatgcctgtaatcccacctactcaggaggctgaggcacgagaattgcttgagcccaggaggtggaggttgcagtgagctgagattgcaccactgcactcctgcctgggccacagagtgacactctgtctcaaaacaaaacaaaaagactccttagattaaaactggattccagcctcagttccactggtcaccattcaagtacttcgcatctctaggtctctgtttctttaacttcaaaaggaagttagcattttccttacagaggtgctgaggattaaatgagataatacatgggaagcattaggcctgtagcacatttagcagatggtggttggctcccatacttttctaccattctgtggcctacagttgaaatggtgggaagaggacatgagatttgaggctggggaaggaggcatggggttctaggaaagcaaggcagtcacttaggcctgaagtaaggggccaggggcctgggcaggcgacagagccccacagtgccctcgctaccctattaatgggcccagaatctgcaaaccagccaccacgtgccctcacacccagggtcttcctgcaggtggagctgaagagccaagaggctcagagtctgcagcagcagccagaccattacctgggtcacctgcagcagtacgtggccacctatcagcagcaggtggccgcctatcagcagctgacctgtgagaaggaggcgctgtacaggcagtgactgcagcagacccagctaatgaaccagttgcagcagcaggaagcttggggcaaagcggtggccgagatggcctgccaaaagttgcaggagacccaggggagggagctgccgaggatggggctgtgagggggacgacctggcaaactctgtgccttctcactctttcctggccccttaggagcgtctggaagctgccagccagcagaaccagcagctaacggcccagttgagcctcatggctctccctggggaaggtacgggagaccgctcagaggaagaggagagagccccaggaggaaggggggactgctagcagcatagtattcaggagttggaagagacctttagaacagctggtcattatactaaccgggtgcctgcactaagttcagcatcaatatggtgacctcctgtgagcggggggccaccaagttgcctaaggatggctgaactggccgaggtcagaaagggagcaggtcagaactcccgcaccgaccagtagtgggaatgtgcctgggcagtatagcaagatcttggttcttcaaagtaaaaataaataacagcagctcattcctctctggggagggcctggctcagggttacacaatgagggtggaggcagaggtgggcccacaatacttcccttgttgagttgtctgaggacccctctggccaccacccccacccccaggagatggaggaggacatctggacagtgagggggaggaggcacctcggcccattcctagcatcccacaggacctggagagcagggaggccatggtgagcctgactccacctgaacccattttgcctccttcctctgtggtccctccaagacccctttatgctcttcgtttccctgccttctgatttctctggaccctcaccccttctgggagccagtggtcagacaccatttcacctgtgaccaacatgtgcagtctctggggccccaagggaaggggctgcgctccacctctctgccccatttgttctgtgtatgcccctgcaagaatgctcacatcttgccctcaggtggcatttttcaagtccgctggagctagtgcccaggagaagcaggcacagttacaagagcaggtgaaagagcagagggtgtgctgccagcgcctggctcacccggtggcctcggcccagaaggagccagaggcagccagaggccctggagccccagggcctgggggcgagtctgtgagtggggagacccaccgggccctgcaggaagtcacggagaagctggcccatgccggaactcacctccgccttctccatgacttgaaaatgccacctgagggcaggtcgctggcgagatgtgaccccattattttggctccagagcggctttatggaccacctggaggagaaggcagacctgagtgagctggtggagaaagaagaacttggattcttccagtactacagagagagatgccatcagtgagtgggaggccagggcatggcagggggagctgcagggctgttggaggggccccagcgtctgagccctgtcctcccgcaggaaagtttatcaccctataacaaagccagggggcagtgccaaagatgcagcaccgggaggaggacaccatcaggctggccctggacagggaggagatgaaggtagagtgtgcaacatctctgcgggggtgggggtggctgtgacggtgagcgctggcagcagcgtgacagctgagcacccctccctccaggtgaagctgctggagctgcaggagatggtgttgcagctggtggcgactacaagggacacagcaaattcttggtgactgcccagaaccctgctcatgagcccagtccaggagccccagccccccaggagcttggggctgcccacaagcatggtggtgagtagagccctcaggcggggtgggcaggcaggagcaggggggctctcactgagctcagatccccgcctccctctctccaaagatctttgtgaggtgagcctcactgacagcgtggagcctgtgcaaggagaggccagggagggttctccccacgacaaccctactgcacagccgatcgtgcaggaccaccaggagcacccaggcttgggcagcaactgctgtgtgccattcttttgctgggcttggctgccaagaagaaggagataaacatcaccatcgtcaaagagctgctgaagaaatttttaaaaaagaaacaaagttatggggttaatctcctacacaattcatttacttcgtttgaatgttatagccacttatgattatttgtgtttctaatttatagtttaagtttatttgtaaatagttaaaagagagtgggtctctgtggctttcactgatgttcactctggcatactttcgcaattttctttttcaatttcataattgtaggtcattagcatgcatattgagtttgcccttacgtggtgggagttcaaacacacaaagacccactatttgcacaaaactattcttgctggtttggaataggctgccatgtgtttttaatgttattgcagcatgtatattcattacagaattcagataaaatgtgcctatgttctgctgttgtttgatctaatcttaatcacagtgagctcttcattagcacaatatgtggtttgccccaagtgtgcactatttaatactttgtaatatgccaccaagagtactgacatttagagttgtttaaaggccgagaactggaaacagcctttccctcattttctgtgtattggtgatgggagtaataacattttgggggagctttttaaatttcacagaagaggaaagttgcctgctctggcaggtatgtgcaagatagagtgtgtttcatttgttctgttgccaagaattagtgctgtactattgtagttcctttaggatttgtatgtgctctgggctcatgaagatattgcatcatgagcttcagcagttgtactcttttttgatgacctaaaaagggcttatttctgaggaatgaaaggttcccatcattgactacggatgtggaaaacctttcctagcttagagcatttgtatctatattttaaagtcagagttcatgttacctgttttaatcacatgactgcatgtcccagtacacaaaagggcactggttggcattcttcttaatgtatttagtaaagatcagaagaaatcctttaagagttcaaatgtccctggaacaggcatacaggctctagtcaagaatgaattagagtgaaggaaagctgtgtgacacctggcattcctctgttcatggagcttctttgaggcttgaagattgattttaccatctagaccactctgcctattcttcaaccaccttggttactttgacataggaattgacttcttttccttgaatggaaaacactttgaaataataataaacattgttataaactaatatatgtgagagtgcttagttgaaacaaaaaggagttttagtagacagtattatactatctttgaaaatcaaggagaagtttatgcaacttaaaatgtgtacaaactgcagtgcaatctactgttggtgaatgtcagtgtattatcaggaaacatgtctatacaatcacagagttatatttcctcacaaacttctttgtgaagagtgaaatgtgtttctgtacctctgggtttcacttacgggcatattttgtgcagtatttatgtgattgtgcctatgcatgatgaatgaatgaatttcagttgtacattgcctaaatcataacttgatgatgcttgggaaagactcaacagttaaaacttcatgaagttctaatgtctgtgttccaaaacacatcacattattaggatgtagggagatatgtatgtgtgctccctggggtggggatttctagttactagaccatctccatttttagcatttggcatcctcatgatacttttataaatacgacattaacaggagagcagcagtacgattttgccgatggaataacagatttgccggcaatcactgaaagagtgcaaacatcgggtccttgtgacttcaacggactcttccaaattgtatgaatgtatcaatgtattagataaacccagtttcagaatgataaagaaaaaatgttagaccaaataatgcggctagttaacagtggtacgatttctcgcccgtggctttaaaatgcacttaaagtcctgtccttgccttttattttctgaacttgatgtttttgcattctttgagttcagtttaaagacaactacgagcatctgtaaccaatctgacaataatgtgttcatcaggtgcctgtggattaaatcacatactggcatatttaagctgaatgtcaatctggaaaataaattgactgtattaacggaaataccactctttgtgtagatatttgtcgtatattgaagaaaaagctaaaaagaatggaaatcgcatgactataacttaagtctttcttcaaagtgcatgcagtcttttgcgatacctcattcagccaagtattggtattcttcctcattcggtataaggcagctttcaatttgcttagagggcaacattggaaggttagagttcatcagaaacagaattctaaaatgtgagttcaattcaataaatttgaatttctgtaggaagaatcaaatcaccgatttaaagattgcaatatataataatcatttttaaagtattggattaaatctgataggttttccagaaatgaacaaaaatcagctctaaaaccaaagctgatttttagaaaatttgaaaatgtaaatcagccctatccatactatagtttctctaaaactttatctgaaagagtcattttaaaataactattaaacaatgtaactgctatcttaatgttctgaaataagttaaaacattttaaaatatgaatactgtaaaggaaataaacggtgggaaggaaaagtagagaaagaaatgccaattccagtccaaagctttatttgccaagttttcttagaatgaattttaccaatttatgaattcttgtaagcggaatgtaaaacggaaatactgaaagacttttgcctaaagtggcattattgactgctggtgtgatgctactgtaatgtaataaattattaagttgttgcaaagtgctgtttttgccttaaaattttattctgtgtgtcttcaaaaatatagtattaaaggtattgatactgtgcaaatgctgggcatgcttggcatgagataatgtttcatttttacaaaattgtaatataactatgcaagggtttattaaaagaacacaaaataaaaaagttatgggattaacaaaagttatggggtgaaaaagttatgggataaaaaatgtaaaaaagttgtggcaaaaaaatcttgtgaccaaaaagtagaagaaagttttatgaaaagttaccaaaaaaagttatgaaaaagaagttatgggatttaaaaaaaaaggcatgggataaaaataaaaattaaaattaaaagcaggcccctgtcagcaaagcctggagaagtggggccggggtctccaccaccacactgtccctatctccccttcccagtcacccctttacaattagggtagcaggacaagacctctgtctaacgaggaaagacaaacagaccctttgccaccttgaccagagctgagtccttaaatttctggatgatattgttatttaagagccagaggctggtggagttggtttgtttggaggaggcctcatggcctccttactctcaccatagcaacttttccctcagtgggggctccaatcttcttattcagagaggtagctgaggcaggacagtggggctaactgtggaccaggcgaaggcacgggctgctggggtggccccccttccccggtgtatatattgtgtctgtgtaaggttttgtatattccagagggtagggccacccctgtatcatacctagcggtggttggaggtggcacatggggaggaggttctaataattatttgtggctgggaaacttacttattgctagcataggacagaggaagaaggcagggatggggtcatggcttcccagtggtgtgatcacagttcactgcaacctccaactctcatgctcaagtgatcctcccacctcagcctcccaggtagctgggagtataagcatgcactactatgcctggctaatttttaaattttttgtagagaaaaggtcttgctatgttgcccatgctggtcttgaactcctgggctcaagcgattctcccatcttggcctcccaaagcactggggttacaggcatgagacattgctcctgtccataagattttctctttattactgttttgttgttggtggtggtgttttgttttgtttttattttttgacagagtctcggtctgttgcctaagctggagtgcagtggtgcaatctctgctcactgcaacctccgcctcctggttcaagcaattcttatgcctcagcctcccgagtacctggggttataggcataagccactgcgcctggctaatttttggatttttagtagagacagagttttgccatgttggccagattggtcttcaactcctggccttaagcaatccgccctcctcagcctcccaaagtgctgggattacaggtgtgagccactgctcctggctaagatcccatctctatttaaataaaaaaagaaaattcagaatctatggaacacagaacaccaaaggccagttatttacctctctgaggtaatctgtgtaaacaatttgatatatatcctttcaagttcatacttgctatgcatacatatatatatacacacatacattgacatattcccccttccctgctgtcatgctattagtcttcttttttttgtagaaattggaccaactctatgttctttgctggcccgtatttctcctattcagtgatgtgttatgaatatctgtttaagtcaatgtatgcaactctttaatatcattttaaaaggttacgacatacgatcatatgaaggcattagaatttattccaacagttcccttttgcacatttaataatttccattgatttgccaggaagaacattctcgtgtcatggctaaatccttttgtatggacatccttaattattcccttaagataaacttttaaataaagttgctagattagtctcgtttcttaagttcttttttggtagtttatatgtaacactgtagttttatatgtacttacaaatacctatagtgccagtagaaaatgggataaaattaaactctttcacatatgccaaatatattttgatttagcgctttattaagtgcatgattacagtctctgtatcttttgatttacctttctatctttacaattttcagccgagatacttagaggtcacatgataaattaaggttttctttttttaataatctccatctttctaaatatggtgagtcacagtcagctatttttggattgttgaaagctgtgactgttctaaatcggagcccagaaatcacgccacttaccaaatatgctttgtcttccaacatcagagtgtctggtagaaggtgactgttcttggaatttaaaaaatctgaacaggacaagacaagaatctggacactttttctgtttctgataatatgattgagtaggtagacacgctggataatccttgcaaagacatacttgaacttcccaaaaaaaaaaaaataaaatccagaatctctaagaatgaagatggagtgaaaatcagaagggctgctgagagaataatggggaagcagccccagttatcaagggacatgtccatgtgttcaatagaaagtttcagatgtaaaaaaaagttgagaaaaataatatatatattatatataataaatgatataattgccctacatatacacatcatcaacaatttttcattcatggtatggacagtttttttttttggttgctttttgtttgtttgtttgtttttaaaggtgggattttgctgtggttgcccaggctggagtgcagtggcatgatcttggctcactgcaacttccacctcccaggttcaagcgattctcctgcctcagcttcccgagtagctgggattacaggcacccggcaccacatccggctaattgttgtatttttagtagagatggcgtttcaccacgttggccaggctggtcttgaactcctgacctcaggtgatccacctgcctcggtctcccaaagtgctgagactacaggcgtgagccaccacacctggccacagccagttttgtttcatttatattcccacttcatttatatacattccttcttcctctgaattattttgaagtaaaacctatacatcctatcatttttaattaccttatatgtatctgtagaagacaaggaattcttaaaaataaatatattcacaatgccattaaatatcaaaaaattaatattctgaaaatagccacaaatccagagttgacattttgttgactttctcataggtgattttttttctagtttatctatttcaatcagataactgtttgctcatatttacattccttactgaacaatgtctaaacttaaactgacataaaatggagatgatcttctaaccagatgcttagtgtaagaaaaaacttcaaactgcaagaggagtccctccaaatacagaaaggaccagtattttaagaggtatgttaactaaaatgtggcaatgtaaggagcaaagcaggaagaacctttaagtcctaaacttacaagtcaatttcatagtcagtttccctggtccttccacaacaacctcccccatctgttttctctacaatggaggtaacaatagtagctattccagagcaggaaaaggcttagagcagtgctagaagagggtcgtggctatataaagtttagctatttgtatattgtaacaaactaactttttttggtcaataatagatttctgttggaaaagtagcagcctcctgtctggggacacctgcagttccactaagtgaacattggtgtctgctaacctttgcctctatttctctcaatatactgtgaagctgttcctggatttagcaattttatatacttctttttattattctttttttcctttcccttttcctgagacacagtcctgctctgtcacccagtctggactgcagcagcgccatcatggctcactgccacctccaccccgggctcaagcaatcctcctgcatcagccttcagagtagctgggactacccaggggggcccaccaggtctggctaatctttgtggtttttgttttgtttttccgttaagggactgggtttccggccaggcacagtgactcacgcctgcaatcgcaccacccctggaggccgaggccggcggatctccccaggtaaggagcaggagaccagcccgaccaacatggagaaaccccatctcaacctaaataaataaataaataaataaataaataaataaataaataaaagtagccaggcttggtggctcacgcccttgatcccagccactcaggaggctgaagcaggagaatcacccaaacccgggaggcggaggcccggcgagccgagaccgcgccactgcactccagcctgggcaacaagagggaaactccgtctcaaaaaaaaaaaacaggtttcaccatgttgcccaagcgggtctggatctcctaggctcaagcgatttgccacactcagccgtccaaaatcctaggatcacaagcgtgagccatgacgccaggccgatctattcctgtctgattaaaaattgggccggttgcggtggttcacgcctgcgatcccagcaccccgggaggctgaggcgggcggataacctgaggtcagattgaggccagcctgagtaacatggagaaaccccatctctaccaaaaaaaaaaaaaaaaaattagcagggcatggtggctcacgcttgcaatcccagccactcgggaggctgagccaggagaaccacccaaacccgggaggctgaggctgcggggagctgagaccctgccactgcactccagcctgggcaacaagagtgaaactccctctcaaaaaaaaaaaaagagagagagagagagactgagtttcaccatgttgcccaggccggcgtgtaactcctaggctcaagggatccgccgcgctcggccatcggaagtcctgggatcacaagcatgagccgccacgccaggcccatctgttcctttctgattaataaattgcgcccggcgcggtggctccctcctgcaaccccaccaccctgggaggccgaggcgggcggatcacctgaggtcgggagtttgagaccagcctgaccaacatggagaaacccgtctctaccaaaaaagaaaaaaaaataagctgggcatggtggctcacgcctgcaatcccaccaccccgggaggccgaagcagacgggtaatctgaggtcaggagtttgagactaccctgacgaagggagaaaccccgtctataccaaaaaaaaaaaaaaaatacaaaaagagccaggcatgttggctcatgcctgcaatctcagccacttggtaagctgaggcaggagaaccacccaaatccgggaagcggaggcagcggggagctgagaccgcgccactgcactccaaccgggcaacaagagtgaaactgccgcaaaaaaaaaaaaaaaaaaaaaaaaaaaaaaagagagagcgggtttcaccgtgttgccccggcctgtctggaattcctaggctcaagggatccccggccctattcctttctgatttatagattaggccttgcgcgctggctcacgcttgcaatcccagcacctccggacgccgaggcgggcggataacctgaggtgggaagtttgagaccagccttatgaacatggagaaaccccatctccaacaataaaaacaaaaacaaacaaaaaacaaaatgagctgggcatggtggctcacgcgtgcaatcccagccactcgggaggctgtggcaggagaaccacccaaaccctggaggcggaggcccgttgagccaagacctcaccactgcactccagcctgggcaacaagagcgaatctccgcctcaaaacaaacaaaaagtgaccaggtttcaccatgttacccaggcaggtctggaactcctaggctcaagcgatccgccgcgcttgccgtccaaattcctgggatcacaagcgtgagccaccatgccaggccgatctagtcctttatgattaataaactggaccgggcgcgctggctcacgcctgcaatcccagcatccccagaggccgaggaggcgggcagataacctgaggtcgggagtttgagaccagcctgatgaatatggagaaaccctgcctgtaccccccccgccaaaaaaaagagagaccgggtttcaccatgttgcccaagccggtgtggaactcctaggctcaagtgatccccagcgctcggccgtccgacgtcctgggatcacaagcgtgaaccaccacgccaggctgatctattcttttctgattaatcaattgggccttgcgcgctggctcacgcctgcaatcccagcatccccggaagccaaggcaggcggataacctgaggtcctgagtttgagaccagcctgaccaacagggagaaaccctgtgtgtaccaaaaaaaaaaaaaaagaaaattagccgggcatggtggctcacacctgcaatctcagccactagggaggctgaggcaggagaaccacccaaacccaagaggtggaggtggcagggagccgagactgcaccactgcactccagcctgggcaacaagagcaaaactctgcctccaaaaaaacaaaaaaaagagagagaccgagttccaccatgttgcccaggccagtctggatctcctaggctcaagtgatccccagtgctccatcatccaaagtccctggatcacaagcgtgagccaccacgccaggccgatctattcctctctgattaataaattaggcggggtgcagtggctcacacctgcagtcctgtagagggatttttaaggaattagatagactcatggggtttaggaggacatttattaattatttaggtgcaccggcccagtcggattaacatttaaaggattgagcactgaaccaagagttacctttcaagcattatgtggggcgaagggggagatctgtgcagggagaagcatattatagaagcgagaaacaaagattgttatttaattgaaacatgcattatattattttttactatttaaggaaaaatatgttttgtgacttgagtttatttgtttagtgaccttgtagttgcacagttaaggaattagtcgggcatggtggctcacaccgcaatcccagccactcgggaggctttggcaggagaaccacccaaaccccggagacggaggtctggcaagctgagacctcgccactgcactccagcctggacagcaagagcaaatttccccctaaaaaaaaatatatatatatgactgggtttcaccatgttgtccaggccggtctggaactcctaggctcaagcaatctggctctggatgtctttaacttgtgattgaaagcgtattaagatgttgggtgtatcaacagtccggaggacaagaaggaaaatcctggcatgtgaaatattctgcaacaagaaaagcaatcggagaggtgactacattcactgcagctgttttgccctcttcttccccacccgccccccccgtctctttcctggaagttccctagtaagaagtaaaagagataatggctttcgagtgcatgtttttcctggaattggaaggaattttaacaaaggagcccttcacaatgaaacccccccacacccctgcttttcacctgaagtaggacaagatcgtcgcccccaccatcattctccacgtgaccccaggtggggatgggtagtggacactactgataagctcttagcaatttccctatttgtggactctgaagctccttagcttgacaactgatgcataagttttcttttgtgggataagaataggagaataggtgaccttttccccctgaattcccatcctggggccagggaagagagcccaggatcccttctcttggccttcacactgtgggaaagagtacctagagttaaaagcctgataaatgccctcgaacagctttgaaaatcacaaggtcaggagatcgaggccatcctgcctaacacggtcaaacccgtctctactaaaaaaaaaaaaaaaaaatacaaaaaattagccgggcatggtggtgggcgcctgtagtcccagctaccggggaggctgaggcaggagaatggtgtgaacccgggagggggaccttgcagtgagctgagatcgaaccactgcactccagcctgggcgacagagcgagactcagtcttaaaaacaaacaaacaaaaaaaaaaaaaaagaaaagaaaagaaaaaagaaaatcactcggcgtgagcgcttgccccctgaacaaatgtccaagtgtatcactatgggaatgcctcttgggtcacagacacagaggtaattctctttgtaaatagattcatgtcatttgtctcgtttctgaacagtttcaaaagaattatttggtgaagtcagtttcctaggagaatccatcacatttccccagaggtatttccacccttgcaaaccattagataaagaacaggtcacgcacagtggctcacacctgtaatcccagcactttgagaggccaggcgggtggatcatgaggttagcggatcgagaccatcctggctaacagtgtgaaaccccgtctctactaaaaatacaaacaattagccaggtgtggtggcaggtgcctgtagtcctagttactcaggaggctgaggcaggagaatggcatgaacctcggagacggagcttgcagtgagccaagattgcgctactgcactccagcctgggcgacagagtgagactttgtctaaaaaaataaaaaaacaaaaacacgtaaagaacaaattagtcctcgtggtaggccacccccaccccatctccagttcaccacttcaatcatacgactttctcagtggacttgaagccaagctttcacatcagagccctccaaccaagagcctgactgtataactcctaagaacaatcaagtaagaatgtttttctttccattcctcacatctggtatctgttgccttgtgaatagggtgcccatcagcaggaagggttagaactagggtaagtgtgtagggagcaaggcttgaaaagaaacagatgaggaaagagtagcaaaatcaagactgtcccaggaagtgagtgtcagtcaaaggttttgaaatccctcaaatagttacttctgctgtcttggttttgtccacctcccttcttttttcacatacctgccaccctaaaaagtaatacctatgcctaacatagagctaaccagttaaagaactgctagtaactttagaaaagagtccctttcccatcagaatcagaacaaaatctttttaaaaaaattatttttggccaggcatggttgttcacacctgtaatcccggcactttggggggctgaggtgggcggatcacttgaggtcaggagttcaagaccagcctaaccaacatggtgaaaccatgtctctgctaaaaatacaaaaatcagccgggtgtagtggcatatgcctgtaatcccagctactcgggaggctgaggcatgagaatcacttgaacctggaggcagagggtgcagtgagccaatatcgtgccactgcactccagcctgggtgacacagcgagactctgtctcaaaaaaaaaacaaaaacatatatatatatatatatatataaatatatatatatataaatatatatacatataattttttcaggcaggggcaatggcttatgcctgcaattttaacactttgggaggcagaggtgggaggatcattttacctaggagtttgagaccagcctgggcaacatagtgagatcttgtctctacaaaaacagttttagtcaggcgtggtggtgcatacctgtagccccagctacttaggaggctggggcaggagaatcctgctgctgcattttgtgctacttttaaaaatatttggtaaaattcaggagtaaagccgtcgggtcttgggcttttctttcccgggaaacttttttttattttttgagagggcgtctcgctctgtcgcccaggctggagtgcagtggcctgatctcgactcacttgcaggctccgcccctcaggttcacgccattctcctacctcagcctcctgagtagctgggactagaggcacccgccaccatgcccagctaattttttttttttttgtattttttttagtagagacggggtttgaccgtgttagccaggatggtctccatctcctgacctcgtgatccgcccgcctcggcttcccaaagtgctgggattacacgcgtgagccactgcacccggcttttcctgggaaaattgtttccgtctcactacttattggtcttttcaggttttggatttctttgtggttcattcttgctaggttgtatgtatctaggaaagtatccatttattctagattttctaatttattggtctatagttgctcatactagcctctaatgatccttagaatttctacagtatcaatgaaaatgtccccattttcatcttgattttatttatttagggttttttgtttttttttagtgtggctaaaggttactggtttggtttatcttttttaaaaaacgaacttttcgttttgttcatattttgtattttttcatttcaatttcattaatttttgctcttatctttattctttcctttcttctatacttattttgggtctggtttattcttgcttttctagttcttttaagatgtatcggcgccacgggccccgcagagccagggcggctcccgccggtagcctgtgtgtgggccccggccagccgcgcccccagtccatatcgcccttcactgccccgaggctggcgcggctatggggcgcggggccggcgctgctctggggcgttggagccgcgcgccgctggaggagctgctgccggggcgggggtctgggcggctcggggggccacgcgggcctcggacggctcccggggctgtgggcttgggcccggcagctgcaggtgcggggctcttgccggccgggcgctcctcggctcccgcgcgccgggttcccgggcggtcccaccgccactgcctgggcaggggaggaggcctggcggcgcgggcgggcggcgccttcccgggacgaccagcggctacgacccatggcgcccggactctcggaggccgggaagctcctggggctggagtaccctgagcgccagaggctggcagctgcggttggatttctccgatgtccggtgttatctccatgtctgcccctttcttcctggggaagatcatcgatgccatctataccaaccccactgtggactacagcgacaacctgacccgcctctgccttggcctcagtggcgtgtttctgtgtggtgctgccgccaatgccattcgtgtctacctcatgcaaacttcaggtcagcgcgttgtgaagaggctgagaacttcgttattctccattctgaagcaggaggttgctttctttgacaaggctggcacaggggaattgattaaccgcctctcatcggacactgcactcctggggcgctcagtgactgaaaacctctcagatgggctcagggccggggcccgggcttctataggcatcaggatgatgttttgtgtctcacctaatcgggccacctttgttgtgagcgtggtgcctctagtgtcaatcattgatgtaatttatggacgatatctacggaaactgaccaaagtcacccaggattcgctggcacaagccactcaggaggaacgtattggaaatgttaagaactgttcgagcttttgggaaagaaatgactgaaatagaaaaataggccagcaaagtggaccatgtgatgtagtcagcaaggaaagaggcattcgctcaggctggcttctttggagaactaggctgtccggaaacctgattgtgctttctgaacctgtacaaaggggggctgctgatgggcagtgcccacatgaccatgggtgaactctctcccttcctatgtatgctttcggggttggaataagcattggaggtctgagctctttctactcggagctgatgaaaggactgggtgccggggggcgcctctgggagctcctggagagagagcccaatctgccttttaaggagggggaagggttatcttaaatgagaaaagcttccagggtgctttggagtttaagaacgtgcattttgccgatcccgcttgcccagaggcgcccatatttcaggatttcagcctttccattccgtcaggatctgtcacggcactggttggcccaggtggttctggcaaatcaacagtgctttcgctcctgctgaggttgttcgaccctgcttctggaactatcagtcttgatggccatgacatccgtcagctaaacccagtgtggctgagatccaagattgggacagtgagacaggaacccattttgttttcttgctctatcactgagaacattgcttatggtgctgatggccttcctctgtgaccgctgagcaagtccagagagtggctgaagtggccaatgcagtggtcttgatccggaatttcccccaagggttcaacactgtggttggagaaaagggtgttctcctctcaggtgggcagaaacagcggattgcaattgcccgtgctctgctgaagaatcccaaagttcttctcctagtgaagcaaccagtgcgctggatgctgaaaatgagtaccttgttcaagaagctctagatccactgatggatggaagaacagcgttagttattgcccatcatctctccaccattaagaatgctaatatggttgctgttcttgaccaaggaaaaattactgaatatggaaaacatgaagagctgctttcaaaaccaaatgggatatacagaaaactaatgaacaagcaaagttttatttcagcctaaggaaacaattactggtaaacaacatgagagactttaatgcaaaacagtattgtagaaaaaaaaaacacctcagagactgcatgaaatatgtaaaccatatatcaagttatttgaaaaatagctattttttccaaagcgtgtaaaatattgctttgaaatgtacctgttctcaagatctttttattcagagttttaaccattgtaactttttaaatgtctgtagcactgaagttattttcaggttttgtattttctttcattgtggaatattttaattaatatagcatggcacctcattttcttttgcctgctgttaaagatggaagctgttgtcaaatgacaactttaaaaagggaagtataaataaaaagcctgattattttaggccagtttgccaatcactgtgtaattcctctggtagtattctacctactttaagtctaattttactagatagagtaatggaaaatgaaaatctaaccctttattccgataatctcatgaagcaaacctaactatttaacatcagctggaaagaagggaacatttatattgcccgtctcctgtgtcttcaaaggtgtgagagttgaggaatatgtgttcctacgggaactatgtttgaatatgtgcagttttcaacattttggcaaatgaaagcctgacaagtttttaaaagggcagaagctttattttttgaacagaaaaatctattttttaaattcacatgtttgtatgagtacttctgggaagcaagggatgaactgctaggtattattaagaacgaatgatttttgcatttaagttgtttgaaggcatgtattttgaaaaatatctgttacaaatttataatttcaagacatactaaatcttataatacttttggaatttcattaataaggctaaaatctgaggaatgtaactaattttcagccttaagacacttaagtttggaagtccttgctattcaacagaataacaagaaaccttcagaatgtatcactctcccaaaaagaagatattaataagcccttttcttttattcatggttatagtttttttatagtctcaaaattcctaaagcaatgctgacagccattgaatttgccatattttgtattcagtgctgttaatgtgctgttgcctcaagaaaaagtgctttttctccattgatgaggctagaccctaagaggtaattaagtcaatgtaaatcaaatggaagttttgccatgaactaagcatttattagttccctgattagactggaagaagaaaccgctatttcatgacaagcatggaatattatattttcttcttcataattaatgaataaaattgatatgagcgaatgaatgtagtattttttgaattagtaaacagtacatctgtgacaatcattttaacaagctctacttgtgttctttataaagtgtgattttcagaaagcaaacaaaacacaattaaaaggttgaatctgaggaaaataatgcttgtaccatagaagtatttacaaaattgcatttcattgttatgttttattttctgatacctgatgttcaattatatctgtaggtaatattttatatcatagattaaaatttatagtgaccttaaaaaaagatgtatcatcaggttatttatttgaggtttttcacttttttgatcttggaaattataggtatacatttccctcttactactgctttttgctgtatcccataggttttggtatgttgtgttgccgtttttatctgcttcaataaatttttcaatttcttctgaatttctttgttgaaattgtaaggatcattagaggctactgtgagcaaccataggccagaaattagaaaacctagactatatggatacatatagatacagaaaaattcacattatgaatttgttctcaaataagctttggtaatttgtctctttaaagaactttaagctgccaaattcttgagtatggaattgttcataatagttattatcatttaaatatagaggttctgtaatgatatttcttcttttatcagtccttttttcttagtcttactagtatgtaacaactttactgattttttcaaaggaacttttcactttgtgaatttatttactttcaatttcatttatttctttcattacctgttattttattttttcaaattacgttttatttgtttattttttcattgacttttaaacctacgtatttttctaatacaagaatttcaaataataaattaccctctcaatttaactctacaccacaaatatgaagcttttattatcataattttgttttattttatttttttaattggcacataataattgtgcatatttatgggtacatagtgatgtttcaatactcatagtgtatatatttaattaccctgatgaggtgatggtaattagcatatccatcattgcaaacatttatcatttctttgttttgggaacattcaatatcctttgctaactatttgaagctatatgttattgttaactattgtcataccataatggtatagagcattagaacttattcctcctatctagctttaattttgaatcttttaacaaatctctccctatccctcccttcctcttatactttccagcctctagcatcctctgttttaacttctataagatcaaaatattttagcttccacatatgagtgagaagctgtaatgtttaactttctcttcttggctcatttcactcacataatacactccatttctatgcacgttgcttttatggccgaatagtacttcattgtgtatctattccttttcccctcctgtcccctcccttcccctcctctcccctcccctctccttcctttcccttcttgagatggagtcttgctctggagtgcaatggtgtgatcttggctcactgtaacctctgcctctcggattcaagtgatcttccacctcagcctcccgagtagctggggacgtgccaccatgcccagctaatttttatatttgtagtagagatggggtttcaccatgttggccaggctagtctcgaactcctgacctccagtgatccacccatcttggccttccaaagtgctgggattgcaggcgtgagccaccgtgcccggcctatataccacattttctttaaccatcatctgttgctggacccttaggttgattccatatcttgcctattgtgaatagtgctgcaataaacatctaggtgcagatgtttatttaatacactgttttccttatttcatattttttctaaattatcttttgatttcttttatgaactatgagttaaatagtgtttcatgttatttacaactatttgggggtttcctaggaatctcttatgtcatcaatttcaaattaaattttattgtgatcagagaatatattctataaaatctaaagcttaaattcatttaaacttactttttgattcagcatttggcctatgttggtggtgctttcaatacacaagaaaacaatgtatattcagcatttgaaatgtagtttttataaatgtcaataagatcaaggtgatttataatgaagttgaaatgttctatagccatacgaatggtttgtcttactgttcaatcagtgatgaacagagggatgttaaaatctttaattattattgtcatttatccatttctcccttcaattctgctttttccttcatgaattatgaggctttgttattaagttggtgtccctttcataattatgaaatgggggcatttcataattatggacatctatgtcatattaggacaataatgtaataaccaattcatcagaggacaataatataagcaatattattgtcctctgatgaattggttatttcataattatgaaatgcccccattttctcttataatgcaccctcttttccagtctacattgcattttgctaatatagccacacaagcttcctaatgcttgctgtgtatatggtttatcttttcttgtaggtttacttttcatctatctgtgtctttatgtttaatatatgcttctggtagacaacattagttgggtctcattcttttgtctaatatgacagtctctaccttgtaattgaataatttagttcataaatatgttaaatgaaatgtgttgccacttttaaaaactgtacaatctcttgtttctcttctcgtatttttgtttaattgtattttaagtattcattttaaattgcatagatgagttagttgcaacgcttttttgtattgagttatttgtattacaataatcatcaatttatacttaactaatctaaattttacttagaggtaatttttgacaacttcatatataatgtaaaaaactgatgacatctgttctatttttacattctctccagtgattgatagtgttgcctactttgtcaaatcaaaacaaggcaacattttcctaaaaagtgatctgtgctccacctatcctattcatatgcacagaagactttcagggcagaaaactattctgcatgatactacactggtatatgaatttgcctaaactcatagaatgtatgacagcaagcgtggaccctaatataactatggaccttggtgataaggatgtgccagtgcaggttcatcagcggtaagtaatgtgccactccagaggagaatgacagcaaggggtcaggctgtgcctgtgtggacacaatgatgtatgagaaatctttgtatctttctttcaattttgctgtgaacttacaactgccctaaaaataaagtctattaaaaaaacccaaaacaacaacaacaaaaactgatgatggtaacatttcctttactccccctctgtcttttgtgattttttttagtataagtttttctatccacatcataaagcccacaataaaatgatatctttttaaatttaaatagtcagtttcccttcaacaaaatcgacagattaaaaaaaagtatttcctgttactcatatacttaccatttctatgcttttcatttcctctaatctggagtttagattcgatgttatttcccttcaggccagaaaacttctgctagcatgttttgtagtacagatttgctggtgacaaattggcccatttaatttttccgaaaatgtcttaattttaccttcaactttgaaagatactttaataatatatagaaacgaacctgatgctctgtcatctccaaatactttagtagactgattctcaaccagggggagttttgccctccaggaaacatctgataatatctcaagatatttttagttgttagcctgggcaaaggtgtgaggaggatgctactgtcatttagttattaaaggcaaaccaagtcgctaaacatcctgcaattcacaggaaatgcccccaacaaagaattatgtggcccaaatgtcagaagcgatagtgccaaagttgaaaaaccttgctttcatatatattttctacaaacacaattgtgtctatatatgtatatacatatatataattctatatgttacaaatctattacagtaatatatgtgcccccccaaatgcaatacacgcacagtacaacgaacaaaaccagaaaattaatattaatatattgctacatctaattatcaagtccgcattaaaatttcaccaatagtcagccgggcacggtggctcacgcctgtaatcccagcactttgggaggccgaggcggatgggtcacgaggtcaggcgatcaagaccatcctggctaacagggtgaaaccccgtctctactaaaaatacaaaaaaaaaaaggaaaaaattagccgggtgtggtggtgggtgcctgtagtcccagctactcgggaggctgaggcaggagaatggcgtgaacctaggaggcgaggcttgcagtgagcccagactgcgccactgcactccaggctgggcgacagaccgagaccccgtctcaaaaaaaaaaaaaaatttttcaccaatagtcccaataatgtttcatagcaaaaggatcaagttcagaatcatgcattgcctttcattgtcatgtctttttaatgtccttgtatcaagaatagatctttagacctaacttaaccaagatttctggcccatattttcttctttttttcctttgctttgcttctccttccttttctcctttcctttctccttcgctttccccttcctttttctcttccctctccccttcccttccccctccccttccttctccttttctctttcccttactttttccttttcccttccttcttttttgaatggctccctttaggttttctgaggtttccttgtgactagagtcaggcaatgcattttggcaagaatatcacagaattgatgctgcgtttttttcattgcatcctatcaggtggtacatgattccagtttgtctcactactgacaatgtttattttgacaggttgataatggtggtatatagtaggcttctatcttgttattctctatttctagattctgttactttattttatgttgtttttcctaaagggtaataggaattctctctgtttctttgtttttgtttatttccctatttttattccttactatacttttagtacatagtacctagtgcaaaatactaatatatgttgaacaccaacagttgttgaacaaatgtctgaaactgactctgtcctgctaccacaaaaacatatatatatatatttttttcctatagggataccatcaactctacatagttgtctaagccaagacctcctgctaggactgattaaagcccgtgcatcctcattatccagagcctgtgttgctcctctagagctatagccaggctaaccattccttctggttaatatctgaaaggaagaatcatgcagcaagaagagaactgtgagggaataaaaatggcacaaacccagcctggatttctctctccccttttaatgatgaatgaatgaaaaaaattcatcattagctgtagttagtttctattacataaaaaggaagctgatgaaacatataactgagttatatacccacatccaattggttctgtttctctggagaactctattaaagaagttattgagtattgtttacatgtacactgacaaatatgtctaaaggttatgtctgaacacctataaatttatatcaatgattctatatagttcattcttattacacttgattctaattcttatgaagttgatgtttggtagaatgaatgataaaaggagattctgtcccctattgaagtgtttgtgtagttacacgccagagttttggagattgaggaaaaggttgagcttaaataattttatgggcaaactcaatgcttgaatgtaagatagtactttgaaagatttggaggatttcataatgacttttacttttgctaattattgatacagtcacttgtaaataagtttacttaggtaagctcaaggaaatcatgctttttctcaggcttattttaaatctgaatatttttactgtctttgcttttacaagaaaatattcatcattgtattttttgtcttaattttcaaagtcaaatgttaattgtttttgtgggattactttggcaaatatgggagatccccaaacaaattttaaaaagttttttcggccgggcgctgtggctcacgcctgcaatcccagcactttgggaggctgaggcgggcggatcacgaggtcaggaggtcaagaccatcctggctaacacagtgaaaccacgtctctactaaaaatacaaaaaaattagccggacgtggtggcgggcgcctgtagtcccagctactctggaggctgaggcaggagaacggcgtgaacccgggaggcagagcttgcagtgagctgagatcgtgccactgcactccagcctgggcgacagagcgagattctgtctcaaaaaaaaaaaaaaaaaaaaaaaagttgtttctgttctcctttgttttctactttctcttaaatagaaatatatttcttgtacaaataaatgccatgaattaaaaaaataataaattatgattttccttcgtgaggatcagttctcctagacattggtttagctaatgccagctatttggtataaaaatctgtatcagtggagaggtaaaaaagagctaaaggaagcataagaaagacaaccgcatctttaggaagttcctctttttcttttcttttttttttttttttttgagacggagtcttgctttgttccccattgttccccaggctggagtgcagcggcgcgatttctgctcagtgcaaactccgcctcccgggttcacgccattctcctgcctcagcctcccgtgcagctgggactacaagtgcccgctgcggcgcccagctaattttttgtatctttagtagagacggggtttcactgtgttaaccaggatggtctcgatctcctgacctcgtgatccacccgcctcggcctcccaaagtgctgggattacaggcgtgagccacagcacccggccaagaaggttctcttaaaaggaatcacttcttgttttcttacaagttataacctcactaccctagagtcacattttttaataacttatgaattttctgaaacttcaaataccctatggccccatggtaaaacatcagatgacatttgcctctcatttaaaccatttttcttttcctctttcttctttatttttcttatactctctcctcatttctttttctctcttcctatttctctttttctctctgcttcttcctacctcccctcgtgactttgtctcctcatcccatcaccgtgctacttagatgccacatcaatttgactagcctcaaatttacaatgaatactttttaaattcatgcttctgaaacttttaaaggatgaagaggtataaatgtctcacataataatttgtttgatggctgaaatgaatggcatttctcaaaaaggccaagggactgaatacagaaatttaaacaataactttccgttagtgatacggtttggatgttttgtcccctccaaatctcatgttgaaatgcgacctccagtgttggaggtgggcctagtaataggtgtttgtttcccaagggtggatccccatgaatggttttgtgctgtcctcctggtaatgagtgagttcttgctctatgaattcacgagagatcttgttgtttaaaagagcctggcatctcccttgctccctctctccccatgtaatatgccagctccccctttgccttaagccatgattgtcagcttcccgggcctcagcagaagctgagcagatactggtggcctgtttgtacagcctgcagaccatcagccaaatactcctcttttctttataaattacccagtctcaggtattcctttatagcattgagatggactaacatagtcagttttgacaacatgaacctttcatattaaaatttaatttctaaattcactcatttactgtgattggtttatagcttttctgtaataatgaatcttacgtgtgactttcaatgtgctttaaaacttgattcactttttagctctatttttggaaactaccagcttccactgttgaggcaaaagtgtcatcattgaggctctcctgctgaggtagctgttgtctgatttcccttcagttctactgctgtcccagtggaaaaagggaatcttcaccacttacatgacatgtttgcctgaactctaatcttccacacttgctgtagaaaagagtaaagtggcagttcagggcagtttaccaatttagaaatggtgtccgctcagtattttcctctgtgtcacttactaaaacatataaaagaaaccatggacattaaaagaaagagagaggtttaatgtgatattttaattctaacaaggatttatgggcacatgaatgctcaaaatcacatacccccttagtgtttttcatctcacacatatcacatcagatacatatcacacatttcaggcacatatcacacagaacttaccgtaattaaattatcagtttttgaaaaatattatcatttgctctctttttttctatataaataaatttttttaaaatatgattttcagttctgggatacatgcacggaacatgcaggtttgttatataggtatacatgtgccatataggtggtttcttatttgtgttttcatcttatggctttggctagaactagataataaaagtatgcatcaatttaagagttatttttaatcatggtaaggacatatctataactactttgttaaatttcatcagtcatgcatgttaaatatcattaaataaatatcaaaaatgggctgctgtaccagaataccatagacttggtggcttataaacaacagaaaggaatttctcacagttctggggtctgggaaatctaagaccaaggtactagccaatctggtgtctgggaaaaacttttgttctagttcaaagaaggctgccctttctctataacctcagttggggaaggagcaagggagttcagggggctgctttagaagggtgctaaacccattaatgagggctgctctctcatgacttaattagttcccaaaagccccaccttcaaaaaccctcacattggcggttagcatttcaacatatgaatttgagagggatgtaaacatttagtctgtagcagtaaatgtacaatataaagtaaatagctttattgttgtgttgcattatattaatatatattttctagtattaaatctttgtatgccaaatcactggggtgggtgatttcttagtaagtgtagaattcagttcctttttctttcagttaagaatattttaactatgtttataagggatactgtttagtaattttattctttttgtattcacttcatcaagagttagtaatagttatatttgctttgtaaaatgaactgaaaggaagccactttttataactttatccatatttcctagtttggggtccattttacaagatgttttaaacagatgcttattaaaaacactggttatagggactttaataaaaatttttaaaataatgttttacatttcttgcaaaaattgatgcctgcaacctatttactgtttttaaaattaaattaagattcatttaagcagtacatgtttattttagtgaaacacgtatttaattttctaagatagtattttttgtctttaaaacaatttctgcatgttttgtttttttttcactttaaattttatgttttctcagtttttgttttatcacatttgctatatttttctgtatcatgggttatttgttaaagaatgaacttgtgtatgtttataaattgttactgtttttgtttataatttattgccttctaacttaatatgtaattagcattccttttaattttgcttgtatgctttgctgtaccattttgaaattcttgagttaaatgcttaactagtttttatcaagtttaaatattaaattaaatatgtcccatcagtttagtcattttaatattctcactcatcagacattttttgggaacaccatatgccttttcatgcagtcagtttcaagaaaatgaaaattactttttatatgtttatactcaaagcttggctagagataagtctccccttccttaagttggggagaaagtgatttcttccaggctatagtcaaaagagatacaattatagtaactttttgtgtttgtttgggttgtttctgtttgtttgtttgtttgtttgtttgagacggaggttggatcttgttgcccaggctggagtgtagtggcataatctcagctcactgcaacctccgcctcctgggttcaagcaattctaaacatattttagcacaaaactgtttaagatttcaatttatatctttttattatgttccatatactcttttgatacattacccattatgttgattattaacgtacactcaagtcaagatcttttattatgtgaggtcatcagtcaatgataacagatattgatgaattagtctcctcatcagaaattgagcaacattttcattcaagacgacacatgggcctttaaagcatattcaataatactgagtctcagtcttctcctgctattttctgaatgtgcatttagacctttatacatctatctatctactgacccatttattaaattttcagcatttactttgtactccaaggaccagaaccatgtttgtcttgttcactgctgtactcctattgcaaggacctagaacatagtaggagctcattaaaccctgaggattcaaaataagtgaatagaggttgtagcaggaagaagtctaagatagcccctatgaccttcattacctcatgttaccctgttgatacctcacacggcaaaggagtcttgcacatgtcactaaggctaataatccgtcagtcttaagacggggggagtatctgggtaaacctaacctaatcacaccaaaacttcacaatcagggagttttctacaactgagagtagaatgggaagtcagagagtttcagagtccaagaagcatttatagcacccttattgactttgaagatgctttgcttcttcttttgagttcagtttgagattatctttctaataattgattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaattttcaatggaaacttgaaaaaatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgagtagctgggactgcaggcacccaccaccacgcccagctacttttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaacttccccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggctgaggcaggagaatggcgtgaacccgggaggcggagcttgctgtgagccgagatcgcgccactgcagtccagcctgggcgacagagggagactccgtctcaaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattgatggagttgtctggaaggcaaggctcagatgggaaggactcttagttatagtgcctgcacagggtaaacttttttttttttcttttttttttgagacggagtctcactgtcccccaggctggagtggtgtgacccgatctcggctaactgcaaactccgcctcccgggttcacgccattctcctgcctcagcctcccgagtagctgggactacaggcgcccaccaccaggcccggctaattttttgtatttttagtagagacggggtttcaccgtgttagccaggatggtctcgatctcctgacctcgtgatccacccgccttggcctcccaaagtgctgggattacaggcctgagccaccgcgcccggcctgcacagggtaaacttcttatatggctgctggctttccgcagatcaaacactccaagggaaccaggtggaaaatgcctggtctctttttatctcactttaaaggtcaggtagaattatttgtcatactctattgattgtagcagtcacaagcacgtccagatttagggaagggagacatagacctattttttgatgagaagaatatcaacctgtttttggactatgtttaaaactgccacacatgacaattacacaccaggtagaaggcatttggggacagacttgaaggaaatgaggaggaatcgtgctctgctgaaacaagagcattccaaagagagaccacagcttgggcaaaagccctgagtcggaatcatgtggacttattcttagaacagcatcgaggaagccattatagctggagtagaatgagaagggggaagagtattagtagatggtggcagagaaataaacatgagaagacggatgatggaacgagcaccttgtacgtcattttaaggactttggctgttcctcaaactgacatgggaccattgaaagatttttttattttttattttttaaatttaacttttaagttcagtggtacacgtgcaggtttgttatgtaggtaaacttgtgtcatgggggtttgttgtacggattattctgttacccacatggtaaacctgctacccactagttgtttttcctgatcctctccctcctcccagctttcaccctccttttcaaaataagacatacgtgcagccaacaaacgtagaaaaaaagctcagcatcactgatcattaaagaaatgcacatcagaagtacaatgagatactatctcacaccattcagaatggttattattaaaaagctaaaaaataacatgctggcaatattgtggagaaaaggcaacatttctacactgttggtgggagtgtaaattagttcagccattgtggaagacagtgtggtgattcctcaaacacctaaaagaactaccattcgacccggcaatcctattactgggtatacacccaaaggaatataaattgttctgtcataaagacacatgcatgcatatgtttattgcagcgctattcacagtagcaaaggcatggaatcaacataaatgcccatcaatggtagactggataaagaaaatgtggtatatatacaccatggcatattatgccaccataaaagatgagatcacaccctttgtaggaacatggatggagctggaagccattatccttagccaactaatgcaggaacagaaaaccaaatgttcccacttagaagcgagagtcaaaggggagaatacatgaacacgtagaggggaacaacattgaaagatataagcaaagaagtgatatcatctgaattgcatttctgagatttctctggcacttgtgtaaaaaatagctgaaaggaatcaacggcagaagctgggagaccagttagggagcttttgcaataaccataagaggaaatatgtgtggcttagactaggaatcgtcaggttgggagtgctcatattcaaatgtggtcagaatccggacattttgagtgagcctacagaaagctttaatactgtctcaaactaaaggatatagaaggttttccctttctcttgccctgaaaccttctgtatcctttattttgagatagtattagaattcttactatcttactgacaattctcactatcttgttttataacttggaacatgattataattatagtattgttaaatattttatttttattttataattatactttaaaaatattattttggtaaataatcataaaatatgaaaaataaatctttccattaactgaatcaattgtccccttgcaggattttggcttcacaacttcctaatccttgaaatattaattttgattatttttctaatatgtacccatatgtctttgagtaaatttttattggaaggacaaatcagtgctggatatacagatgccattgcttcgtactcaggtaaagacaacctgatatttatgatcctcttgatcatatttttattctcttaaaatctttatgtcttctaataatgttaacagagaagaaaaaaagtcttatctaagcctgactttttatttttaaggaagtttttttctttatttgtaaaattcaggagtttggctagttgttatttaaatatggagaactcttccttgtttcttccccctccctgcctagaaactggttggtgcttttattattcgtacttcagtgatagctttgattattgtttcagatctccttgcccttgtgtctttccccagtacacaaactattctcgaggtggaacctgtggtctctggcatacccatccgccttcttctctgtcattagttcatctcttcctttgccctccagagctctgattcaattgctgcttgaacttttcagtgtgtcagtttctttctccacggatttccctgtggatggaaaatctgcccttgcactttagttttcatagaagcctcatctcagctatctcccattttgtgatatgagcctcttttgttattgtagccttcatctcctatttcctaaattccatgtgtttctacatactgttcatagacaaatagtttaaagcaatgttctatagtttcttgtggtttgaaagtcatatatttttaaatacgttttctccccctgagaattcagcatacagtttcatttttcttgtacgcaggatgatttttaggattttttttctgttatattttttccattctggttacctagaaggtagtgattattaccccaaaccagggtttgatactgtgttagtccactttcatactgctatgaagaaatacctgagactgggtaatttataaagaaaaaaaggtttaatggactcagttccacgtggctggggaagcctcacaatcatggcagaaggcaaaggaggagcaaagacatgtcttacatggtggcaggcaagagagagagcatgtgcaggggaactcccctttataaaaccatcagatcttgtgagacttattcggtttcacaagaacaacacagggagaaacccatccccatgattcaattacctcccactgggtccctttcatgacatatggggattatgggagctataattcaagatgagatttgggtagggacatagccaaaccatatcattcttcccctggcgcctcctgaatctcatgttctcacatttcaaaatcaatcatgccttcccaacagtcccccaaagttttaactcgtttcaacattaactgaaaagtccacagtccaaggtctcatctgagacaagtcccttccacctatgagcctgtaaaactaaaagcaagttagttacttcctacatacaatgggggtacaggcattgggtaccccccaatgtatttacacctgttccaaatgggagacattggtcaaaacaaaggggctacaggctccatgcaagtctgaaatccaatagggcagtcattaaacgttaaagttccaaaatgatctcctttgactccgtgtctcacatgcaggtcacactgacgcaagtggtggtctcccatggccttgggcagctctgcctctgtggctttgcagggtacagcctccctcctggctgctttcactggctggcattgtctgtggcttttccaggtacacagtgtaaactgtttgtggatctaccaattgggggtttggagggcagcggccctcttctcatagctccactaggcattgccccagtagggactctgtatgggagacagagcccacatttcaattctctactaccctggaagaggttcttcatgagcccctgctcctgcccccgcaccccaccagagcaaacttctgcctgaacatccaagtgtttccatacattctctgaaatctaggtggagggtcccaaacctcaattcttgacttctgtgcgcctgcaggctcaacatcttgtggaagctgccaaggcttggggctgcaacctccgaagacgtggcctgagctgtagcctggtgtctcccaccccagccatggctggagtggctggaatgccgggcaccaagtctctaggctgcacacagcagggggacctggacctgctccaggaaatcatttttccatactaggcttttgagcctgtgatggaaagagctgccgtgaaggtgttaaggtctttaatgttctggagacattttccccattgtcttggtgattacatttggctccttgttacttatgcaaatttctgcaggaggctttaatgaaagtcggtttttcttttcttttctttttttttttttttttggattgggagtctcactctcttgcccaggctggagtgcagtgccgcaatctgggctcactgcaagctccgcctcccaggttcacgccattcctcagcctcccaagtagctgggactacaggtgcccgccaccacgcctggctaatttttttgtatttttttagtagagacacggtttcaccgtgttagccaggatggtctggatttgctgacctcgtgatccgcccgcctcagcctctcaacatgctgggactacaggcgtgagcccccgcgcccggccaaaaaatcttatacattataatgctcaaattttatcctttaataagtcataacggagaaacatgctaatgatttcacaattaaatgtgacgttcatttagtgttttgctttgtaatattaaatattttattgttttccatgtgataccttttcctttaaaattctacttaatctacttaaatctacttaaatcgatgatgttataaatagtctttgatttttactttattaatctttgtacattttaatatcgttaaacttacaggaacagtttgtacacttcatggaaatagagtagagtaatagagtttgattatttgttttgttttcagctgagggttttttttttttggtaatttcagtcttagagtctttcttttcagcagttagtggtataattcatatttgtttctcatagctgattttttgttttaacttttgtgaacttgcttatagtttctttacaactattaggctggtgcaaaagttattgaagttttcactaattattattattattattattttgaggcggactctccctctgtcgcccaggctggagtgcagtggcgcgatctcagctcactgcaagctccgcctcccgggttcacgccattttcttgcctcagcctcccgagtagctgggactgcaggccccggtcaccacgcctggctaattttttgtatttttagcggagatggggtttcaccatattagctaggatggtctcgatctcctgacctcgtgatccgcccacctcagcctcccaaagtgctgggattacaggcgtgagccactgcacccggcctaattatttgttttttaaaagatggtacatacgaggaagtaaatcaggaaaggaggatagtgattggtggcagtagaagtgagtcagtgttacagttactattgctgcttaagaaactaccccaaatggcccgggcgccgtggctcacgcctgtaatcccagcagtttgggaggctgagacgggcggatcacgagttcaggagatcgagaccatcctgcctaacacggtgaaaccccgtctccgctaaaaatacaaaagttagcnnggtgtaaataccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagatttgcatttctctaatgcaggtctatgagtttcttattcatggtcactaaaagatgtttatcatgaattgaaatctccagataagagtaaagcaatgcctaattcatagttacgcacttatcaatttatttattcatattattcattatcattatgaatattcaacacattaataaaagagtcacatgtgcaatctacttggggtattgggagagtaaagaataacatagtggtgctacaggtaatttaagagatggtttctctctctctctctctctctatgtgtgtgtgtatatatatatatatatatatatatatatatgacacaggtataattattttccttctactatttgttattgatgtatactgccaaatccctaacggatactggaatacttaactctaagctccccccacgcctacaaaagaagtgggtacaaggttagtttttaaatcaaaagatttattaatagtatttttatcatgtccaattgatattatcattatcaaaaagtttaatcacttattattacttgaaggacctcgttaggaaatattcgatccactctccagcgatttgggaggtttaggagacagagtctcattatgtcacctaggctagagtgcagtgagccgagattgcgccactgcattccagcctgggcgacagagccagactccgtctcaaaaaaataaataaataaacataaataaataaataaataaataaataaataaataaatgtcttacttcaatagcttttggagcacaagtggtttaggtaacatggataatttgtatagtggtgaagtctgagattttattgcacctgtcacctgagtagtgtacattgtaccaaacatgtagcttttttattccacacccacctgccaacttcccccttatgaatttccagagcccattatatcactcagtggagagtcttcaacattcagggtggaatcttcagggtgtggccctctatccattgctttccaacgtttgtactctctgctttgtgaatagaggcctgttctccctgtctgccttgttcacgtacctttgccgttttccttgctgggatgacatcctttgccctgaagttctcattaaccataccatagatgtcctcttcttacctcaatacatccaaggctacctcaagttataacttctcctttagtttttccctagtgtctgagttcaaatgggcttctctatatccagaatatctaccacctgtcttatctttcctcacacgtggcacgtgcagttccttccatctactttcataatgttgtattttaacggttcagttgtgtttatattacactcttctgtcaggcaaacaagggtatttatatggctgaaatctacggtattttttaaatgtagtaaaatgtaatgaataagcatacaaatgaatgagttaattaatctgttatattcttggttaagtaatgagcattatgaggacaaaaattgagtcttacaccttcttataatcctaaagacctagtacaggacttggaatatagcattcacttaagacatctttgtgactaatgaatttaaatatttttattaattctaagttgacgtatgattgtaatttggggaaggtagtgaaatttcaaatggctttcaccacctgtgaaatgaccctttttacctaccacatgatttaccagatctttgtttaggtgaacctaggcgaaagcagattgtttcctctacttaggaaatacttcgcacattttcgttgcttataaatttgatgattttaatttgtacagttataatttatgatattgacttgtacagttatatatattttacatataatatatattatatattatatatagttatactatatataattttattttctaaagtaaagaatatcattacacattaacaaaatagatataactgttttctttctactatttgttactggtgtatactgcaaatccctaatggatactgaaattcttatctctaagcccctctatgactatgaaaagaaatgggttcaagtttattttaaaaatcaaagagtgtattaataatattattgttatcatgtccaattgatactatcattattaaaaagtttaatcacttatttcttgaaggacctaattaggaaatatatatgtgtgtgtatatctatattctatctatatatatcctatatctatattccatatatattctgtatctatattctatatctgtattctacatatattctatatatagtctatctatattctatctatatcctatatatagactatctatatcctatatatagtctatatatattctatctatatcctatatatagtctatatatattctatctatatcctatatatagtctatatatattctatcgatatcctgtatatagtctatatattttctatctatatcctatatatagtctatatactctatatatcttatatagtctatatatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatattctatatatatcctatatagtctatgtatattctatatatatcctatatagtctatgtatattctatatatatcctatatagtctatgtatattctatatatatcctatatagtctatgtatattctatatatatcctatatagtctatgtatattctatatatatcctatatagtctatatgtatattctatatagtctatatatattctatatgtgtatcctatatatattctctatacatattctatatatatatacacacacacacacacacatatatagtagcctgatatttaaaaaataagattgggactgcgtaaaataagctcacccagacaataggggtacagacatatgtataattcagcaagaactggtaacaaagtgagatatgtcaactctttgtagcatattgttaagtagtattaaaaaacaagtaatttttggttgggtccattgagagaataacattatttttagaatgatctaatggcacaataagcattttagcattttacctgcaaaagcattatagctgtgccagtttctgttccaagaaaaaaatacattggtgtattctctaaaggaggaaattctgacctcaactatgttcagatagctgtggcagataatactctgatcaggtactaagtcatatatctttcacatttccctttgctagttatactcagcatgtggttggaaatggaatcaaagcccagtctggaaatcctgaagtcaaagtcaaaggaactgatcctgtgataaatcagattattgataaactgaagcatgttattcaggtaagtcctgatcctatattttttggtatagccaataataaataataagtggtcactttctgttatacttgataaatttgttaaccctatcaggtaatcctgcctaaaatattgtaacacattatttgtatcaggacttttgggaatatttagtttaatgatttttgtatgcagtcaatatgcagtggtattttaatgttggacaatctgtatatgtgaaaagcaagcctcagcctcagcatttcaataatgagaatctcaggacatgcattgtcttcagtgaataagtttgaacgtgggaatcactgtgaccattaaagaaaacacatagaagaccatagaagatgccagagttttctttcaggtaattctctgaatgttgctatgaaggtttttgcagcatttcaatacaaattaggtcatagatgaataatatgtacttctaatatttatttcctatatcaccttttatatgttatcttataatctacctaatggttgtttatgaaatacttctgttttatcttcaataatatttttcatcaagtgagtgtgtattgctgtttttaatacatgacaaatgaagcatgaacatatttatcaaaataatatttcattgaaatagtctattaattagaaccaaacatgatgttgcatgttgtaaatattactctgcattctgcatctattgatgtttggggaaagaaaggctatttttttttttagttaatagtcattttataaaaatttatatttgaatatactttcatttttcctaagcagaactttgcatggctagttgatgcttatttctagtatcgtgcatcagaaacaatacctaaatagtacagagtttttattgcatacaacatattccagagtcagtagtaggcttctcataattgttctgcaaagacaaagcttaagtttatgcagagccaattcctgggtttccatttttcacgagtccctatctctcaaggagaggatatgtaagaaggacttgggggttggtgtccaataccatagacttctcccttctgtgaggcaacaatgcttattctaccattgatacctatagaaaacagctctcaccctggctggcaaaaccaaaaataaattctactggaaaagtctaagagaaaagtggtatcatgactactgatgagttaaaccttccagcctctgctgagctggtccagttggtacctcacagtatcgtccactgtagtataatatgtacagctagattatttgaaaattcgaccgcataattgataataaaaccaaaagagctttaatattaatgttctctcattgaggagtgagtacaatctcactgtgaggacacagtgaaatcttaggggtttcttaagtggggtaagcattccacagaggatggaggaagaaaaactagaacttaaatatatatttattccatctcattcttttatatttctttggttgtagtaaggtatataaaatatgtaatgtattagtgcaatagcatatacatataatttataaatacataaatatacatattaactggacatttgttcagattgtttttctaagatatatacatgatgaaagcagaacagaaaccctgttacagataataaggatagagctgttccatgagaagtgcagttataagaaaacacattcacagaggaacacatagatacccaagatagaaaggattataaaaacccttaggaggagggctcatatatttattacccattcagcaacccccctccccatttcttgtttcgtaggtttcaaagccttttcaaggtggcagagggaagtcatcctgcctttcttttttagcttctgtgtgaacttgagtcccattctttattctttataggagtgtgcagatctccaattattcatgcttaagtttcattctggggttgcaagagaatatcaaatgcagtgctacctttgaggtctatcattttaagatctgctagatttatatgatagaaatgtagatttttatagaggacagcagaaagtcatatcttgcacaggtgtcactgaaaatttacctttaatatctaagaatatgctctttcatgaactgctctcctggagatgaagagaagtgttttactttgccaattttttttttttttttttttttttttttttttttttttgagacagagtttccctcttgttgcccaggctggagtgcaatggcgcgatctcggctcgctgcaacctccgcctcccggattcaagagattctcctgcctcagcctccagagcagctgggattacaggcacgtgccaccacagcccggctaattttttttgtatttttagtagagacagggtttctccatgttgctcaggctggtctcgaactcccgacctcaggtgatccacctgcctcggcctcccaaagtgccgattacaggcgtgagccacggcgcccggcctactttgccaaacttttgactactgatggtgtacgcgtgccctggcagggatggccattgtgctgtcagtatcaagggatggctaacagcacccaccacaatgtcagctatgaaaggattcagaaaatagccttctgtaagtcagaatttattaattaaggagtagggccatggaagatgtcaacataggaataggtttcagattctaaactgtagatttagatgatcacttcttagtgtttgtataaaatttactttattttttattataacatgaagttcgctttccacctttatactatgaaaaatgccgtgtctcacaatagggacatacctgtgttaaagtatatggaagtaaatcagccacaatagcaaacattgcctgcatggactcacccaaaaatgcctttctcggcctgccattgatctgaacctcatttctaccttgcattgtctgcaattagagtcactaaggaagtagataaagatttttacttggaaaatgtcactttttaatgttttaataattaattcgttcaagatactcaacaaatgctcactgagtttctagtacggtcctggttctgtacaggcactgaggttaaagttgtgaataaagcagacacaaccctgctctcatgggctttccattgtaagaaaaaagtaaataaacaaaccaatgaaaccagtattgtagctgacacatgttatgcacaaaaccaaacaaggtgaggtaaggaaagatatttaagaagagtgtgctggtgaaggccactcaggggcagatgtttgggttgatgctgaataaggagaagaaaggagtcatgggaaaacctgtgagaactgtgtctggggcagaaggcaaagtaggtgtaaaggccctgtggcaggaataagtttattttattcagagaacagaaggccaggtggctaaaacagagtgagttaaagggaggagataaacatacatcatgttttggggagtccagtaggctctggtaaagagtttatattttctcctaaatagactaagaagtcattttaaaactgtaagcagaaactagctgcgcgcagtggctcatgcctgtaatctcagcactttgggaggctgaggtgggtggatcaccttaagtcaggagtttgagaccagcctggccaacatggtgaaaccccatctcttctaaaaatacaaaaattagctgagcacggtggagcgtgcctgtaatgccagctactgaggaggctgaggaaggagaatcgcttgaacccaggagtcggagcctgcagtgagccaagatcgcgccactgcactccagcctggatgacagagcaagactccttctcaaaataaataaataaataaaaatacatcacaaatttaataaataaataaataactgtaagcagaagctgatacaatttaatacatgttttatgaggacttcactatgaaaactggaccctgcgtacaagaatggaaaaaagaaagtaacacagacagaaggccacataattggagctagaataataagagtggataagctgagaagtgcatagatttagacaaatattggaagcggggtttttgggatttgttaatggattggaaatttgggagacggaagaaagatgatagcgaggtttggtgggatgatagtgtcactaagtgagaaaaggaattctgagagaggagcaggcctggcggagggtccctgggattgattagaaatcagtggttttgttaactgtgagatgcttgttagatgcccaagagggatgtgcagaactcagggagaccacacaactggaggtgtatgtttgtaagcatcagcacgtggatagtatttaagccctgagattgtataaggttgtcacctttcctttagagtataaattcacaccaaaactattggtggagatgataggacaagggaatcatacaaaaaaaattgtactgcaaaaagctatgaatgaataaaacattttattaaatgtatttggcaccttgtatatacctagttgatctaggacagagaagatacttagtaacattcattttttcttactgtaagaataatgacccaggaggcggaggctgcagtgagctgagcaggccactgcactctagctctagcagacagagtgagactccgtctcaaaaaaaaaaaaaaaaaaaagaataatgaatgctcatcagagggaattgaattttattattctaggaaatctgatggaaaaagtgaaaaataaatattgataccatttataaaacaatgaaaagacttataagagaagccatctaggcttttctctatacttaattatacatataaatacatcagtactttacttcaaaaaataagatcatagggtacatttgattttatgatctgaactgctcacctgaccacacaaaacaaatactttaccatgacattaaatagtctgctctctggttgttagtgctggcatactattctatcatatggaaaaattacagttttccttcacccagtcaccgaaagtggatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcaagtataacagaaagtgaccacttattatttattattggctataccaaaaaatataggatcaggacttacctgaataacatgcttcagtttatcaataatctgatttatcacaggatcagttcctttgactttgacttcaggatttccagactgggctttgattccatttccaaccacatgctgagtataactagcaaagggaaatgtgaaagatatatgacttagtacctgatcagagtattatctgccacagctatctgaacatagttgaggtcagaatttcctcctttagagaatacaccaatgtatttttttcttggaacagaaactggcacagctataatgcttttgcaggtaaaatgctaaaatgcttattgtgccattagatcattctaaaaataatgttattctctcaatggacccaaccaaaaattacttgttttttaatactacttaacaatatgctacaaagagttgacatatctcactttgttaccagttcttgctgaattatacatatgtctgtacccctattgtctgggtgagcttattttacgcagtcccaatcttattttttaaatatcaggctactatatatgtgtgtgtgtgtgtgtgtatatatatatagaatatgtatagagaatatatataggatacacatatagaatatatatagactatatagaatatacatatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatacatagactatataggatatatatagaatatatatagactatataagatatatagagtatatagactatatataggatatagatagaatatatatagactatatacaggatatcgatagaatatatatagactatatataggatatagatagaatatatatagactatatataggatatagatagactatatataggatatagatagaatatagatagactatatatagaatatatgtagaatatagatatagaatatagatatagaatatatatggaatatagatataggatatatatagatagaatatagatatacacacacatatatatttcctaattaggtccttcaagaaataagtgattaaactttttaataatgatagtatcaattggacatgataacaataatattattaataaactctttgatttttaaaataaacttgaacccatttcttttcatagtcatagaggggcttagagataagaatttcagtatccattagggatttgcagtatacaccagtaacaaatagtagaaagaaaacagttatatctattttgttaatgtgtaatgatattctttactttagaaaataaaattatatatagtataactatatataatatataatatatattatatgtaaaatatatataactgtacaagtcaatatcataaattataactgtacaaattaaaatcatcaaatttataagcaacgaaaatgtgcgaagtatttcctaagtagaggaaacaatctgctttcgcctaggttcacctaaacaaagatctggtaaatcatgtggtaggtaaaaagggtcatttcacaggtggtgaaagccatttgaaatttcactaccttccccaaattacaatcatacgtcaacttagaattaataaaaatatttaaattcattagtcacaaagatgtcttaagtgaatgctatattccaagtcctgtactaggtctttaggattataagaaggtgtaagactcaatttttgtcctcataatgctcattacttaaccaagaatataacagattaattaactcattcatttgtatgcttattcattacattttactacatttaaaaaataccgtagatttcagccatataaatacccttgtttgcctgacagaagagtgtaatataaacacaactgaaccgttaaaatacaacattatgaaagtagatggaaggaactgcacgtgccacgtgtgaggaaagataagacaggtggtagatattctggatatagagaagcccatttgaactcagacactagggaaaaactaaaggagaagttataacttgaggtagccttggatgtattgaggtaagaagaggacatctatggtatggttaatgagaacttcagggcaaaggatgtcatcccagcaaggaaaacggcaaaggtacgtgaacaaggcagacagggagaacaggcctctattcacaaagcagagagtacaaacgttggaaagcaatggatagagggccacaccctgaagattccaccctgaatgttgaagactctccactgagtgatataatgggctctggagattcataagggggaagttggcaggtgggtgtggaataaaaaagctacatgtttggtacaatgtacactactcaggtgacaggtgcaataaaatctcagacttcaccactatacaaattatccatgttacctaaaccacttgtgctccaaaagctattgaagtaagacatttatttatttatttatttatttatgtttatttatttatttttttgagacggagtctggctctgtcgcccaggctggagtgcagtggcgcaatctcggctcactgcaagctccgcctcccgggttcacgccattctcctgccttagcctcccgagtagctgggactacaggctcccgccagtacgcccggctaatttttgtatttttagtagagacggggtttcactgtgttagccaggatggtctcgatctcctgacctcatgatccgcccgccttggcctcccaaagtgctgggattacacgcttgagccaccgcgcccggccaaggcatttaaaaaatgaaaacaaaacactatcacctgagtcatttgtttgcttacattaaatatcataatacttttcagcaaaaaatattatcattttaatgtaactttcgttccctgtatttgagcggagtactgcactatccataaacaccctctgaattttctacagtaatggaaaaaaatctttgaaaaaaataaaagaaggttctatgtttgagaatatggctatatgaaaggggtttcaagaaatatccagttcttcccaagacgatgtacttccagtgaccagttttaagaagtggaacaggccaggcgcggtggctcacgcccgtaatcccagcactttgggagtccgaggcgggcagatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggcgtgaacctgggaggcagagcttgcagtgagccgagatcacctcactgcactccagcctaggtgacagaatgagactctgtctcaaaaaaaaaaaaaaacaaaaaaagtggatcgaatatttcctaacgaggtccttcaagtaataataagtgattaaactttttgataatgataatatcaattggacatgataaaaatactattaataaatcttttgatttaaaaactaaccttgtacccacttcttttgtaggcgtggggggagcttagagttaagtattccagtatccgttagggatttggcagtatacatcaacaacaaatagtagaaggaaaataattatacctttgtctcatatatatatatatatatatatatatatatatatatatatacacacacacacacatagagagagagagagagagagagaaaccatctcttaaattacctgtagcaccactatgttattctttactctcccaataccccaagtagattgcacatgtgactcttttattaatgtgttgaatattcataatgataatgaataatatgaataaataaattgataagtgcgtaactatgaattaggcattgctttactcttatctggagatttcaattcatgataaacatcttttagtgaccatgaataagaaactcatagacctgcattagagaaatgcaaatctaaaccacaatgagataccatctcactccagttagaatggcagtccttaaaaagtcaggaaacaacagatgctggagaggttgtggaaaaataggaatgcttttacactattggtgggagtgtaatttacttcaaccattgtggaagacagtgtgtgaattcctcaaggatctagaactagaaataccatttgacccagcaatcccattactgggcatatactcaaaagattataaatcattctacgataaagacacatgcacacgtatgtttattgtggcactattcacaatagcaaagacttggaaccaacccaaatgtccatcagtgatagactggattatgaaaatgtggcacatatacaccatggaatactatgcagccataaaaaaggacatgagttcatgtcctttgcagggacatgcatgaagctggaagccatcattctcagcaaactatcacaagatcagagaaccaaacgccgcatgttctcactcataagcaggagttgaacaatgagaacacatggacacagggaggggatcatcacacactggggcctgtggggtgtgggggtgtaggggagggataacattaggagaaatacctaatgtaggtgacgggttgatgggtgcagcaaaccaccatggcatgtgtatacctatgaaacaaaactgcaagttccgcacatgtaacccagagcttaaagtataatttaaataaataaataataaataaataaataaactcatagacctcaaagtatgggaagcctaactgcctacggccacttgctgcttcactctaaaatctgtttctgcatctgcccctcagtcaatgactgaggcccacagggtggctaatgcagatccctctttaggagacacagggcttctctgaggaccagtcttggctcaggattccctgaagccttttctcacccttccttagactgtacattacgctccaatgcttccactcaaccttcctttcctctttccttcattctaggtcagacttgcctcatagctgagacctcttccaggcttactcagcttcctctccattttctctcacagggatttcccttaataaaatcctcttgtgtttaactcgttttcaacatctacctcttggaggacctggactaacccaccacataatgtttgtattataattacttccattctacaggttgagaatctgggatctggagaagttaagcaacttaagttactcaagtaaggccacacaacgtatataaagtgtgctgcaaggagttaaacccagggaacgcacactccaaaacagaaccatcaacaagtaccaatcctgaaaccaactaataaaaggtaaagatacaattagcttggtgcaaaatgttatttttctctctaattacattttctaaggtttcactgtttgtgattaagaagggatgaatgattttcatcaaaactctgctcaacaagccgggtgtcgtggcatgcacctgtagtcccagctactgaggaagcagaggcagggggatcacgtgagcccaggaggttaaggctgcagtgagctgtgattacatctcgttgaccatgtgaccctgagtgtaactcatagacctcaagcctgggcaacagagcaagactctgccttaaaaagtaaaactaagcaaaacaaaacaatcctgaacaaatggttgcacataaccagctaaacagtaatataacagttgttggcagggtgagaagaaactagcagactgtaggtttgtcatactgtttttttgtttctccagaaacacagatataatataggcaatgaaagctgagactcatctcttaatttcagttaagctattaattgatttacatcatttacttacaggtcagaaaagtttctttcaaaaggcaggaatgttgtttcatgttaatctaaggacttgcttaccttttgtttctgttcttaatgatcacagttactaatacagttaaataatatttagataaaatacattacaattatagctgatcaaaaatctcattccaagctgttatattgttgactatctcatgatcactcttcttatgaatcatgtaaatagggaaaaatactgcaaagtagacccacgttacttcaaatgaaatatgatttaataaaatcagttattctttgccaattttgtaatgttcaaaataaccacaattgaaatagtgatacatacacatcagaacagttcaaatgaaagagagaaatgataccaagtgttggcaaagatgcggagcaactagaactctctcccattgtggatggaaatgtaaactgatggacaccaccattttccatgtatgctaaatctgaccatattctatgaccctgagcatatacccagcaatatttaccaaaagacaaatacatgaatgctcagagaggcaccattcaaaataaccacaaattgaacttatatttgtataatgatatagtatatagcaatgagaacctaacaaattacaactatatgcaaaaagattaacaaatcttataaactaaatattgaatgaaagaagcaagatacagaacatattctacgatctaattcactaaaaattgtaaaactcatcagttatgttccaaatcaccataagagctatcctatgaaatagtgtctagaagaagtaataatataaaatttcctgatttgagtactggatacacagaagggctaagtttgtttaaaaacaaaagaagtattgagctgtacagttaagatttgggtattttactgtttgtatgtattttcagcgttagaaaattatgttaaaaagtctttatgctctttttcttaatatatttacaatagacaaattttcattaagccacagtataaataaaaaagacccacacaggtatttttaacatggatgaagtggttctgccatcattaaatgagtactttaggatgcaagtctgatataaaaacttacttccctgaagactttaattttgcatgcaaaatacacggtttctaaattaaatttttttgtaacaaagcgtttttgagttcccctcatgaaattttaataaatcattaatttcttctttttctctttcatgcacaagcagtggataaacatttcaaagatccctacagaagtttcttcccttgaaatactgttcacatgacaatgagaaggatggaataaaacacaaaaaaggtaagcaatttttttttttttttgaggcggagtcttgctctgtcgcccaggctggagtgcagtggcgcgatctctgctcactgcaagctccgcctcccgggttcccgtcattctcctgcctcagccttcgaagtagctgggactacaggcgtccgccaccgtgcccagctaattttttgtatttttagtggagacggggtttcaccgtgttagccaggatggtctccatctcctgaccttgtgatctgcccgcctccgtctcccaaagtgctgggattacaggcttgagccactgcgcccggccaacaggcaaatttttcgttggggaagtagtagaccaaccatctgtgcttatttcttctaaacagagctgggaatgagtgacagcagttgaacaggaacacttgctccccaagcactacttgtttttcatgaagaaggaaaaaaggcaaaagccctgctacatttacattcgcaaaattgttttcaaatgaggattaacaagatgttagttccctctctgttgaacacataaaatattaaaaggcagtgctaatacatctatatacagcacatcaggaggaaggaggaagtcatttctcctgactttaccaacttgtcttatttgaaactgataccgtgccctattggctgataggagtttcactttatttagaatacaatagaatttggctcagattcacaccaaaagtatagtattttgatgtgcacttacacgatttcaggggaaaacaatatctggaatgtgaccctggaattcattacaagtcagctaaagggatctctcttagaattttttcataattggactgggacaggatgtaagaataaatcattaacagtagatgaggaaaacacttgacgagagctttctcgtcttaccattactgctctttctatcagaggttaaagacagaatggggaccatgttgtggttgttattcttgttgtttgattggtttgtttattatgttcttgcaggacttggttatgtggctggatatgaaaattctttccatttccagagtcatacatctcctaatttctaggagattaaatactggttttatctttggctccagtaaaaatgttgctatcttggattaaaagaaggttgggaaatacgttgtgtctattcaccagtgaatgggaaccccttctacaacaacaaattttccattcaaaccatttctaggcctcccttcctggttctgatagcaaatgtgaaagcaagtactagagatttgggttttgtaagtttcctcaaatacttgggaaatactggattccgttgccaagtgttgccttttgtacattcagcttctacacagcacgttttctctatgttgaaagtcctaatccttgaaatctcagaatggaaaagagttatatgactaattttatgtgccaggattatgggaataaactttcatggaagataggaagcttacagggcatctagagaaaggagacatctgtagaatcaattcagaatgattaagccccttgtgatctcactatctcacttcaattgttaagccacaaaactctttttaagttaatctctaacatttatttggctttataattacatataaataatgtctaaatttgacacctatgtttccaaacttaataatgaagtcaaaataaacagaattaaggagagcttattacgatctttattgttatttatatataacaaatttcctattaagaatataatattttatgatatcttatggatgtcattaacattgctttaataaaggtattatcatgctttgtacagcaaccaacacgaaaatgttactataccactgcaataaatagaataaaaacatgttcagaaagacttagaaactcattaaagaatggatgttaatcacttttcaccctaactcctcatttggcaaggcatgaatctatgcattccagtttagacaggtggcaagtaagtagtcccattgcatttcataaaataagcagctgcgtgaatttgaaagatactatttccacatgaaaagctaatgactgcacatgtaaaatcagtagtgtttaggaagctgtcatttaaaaaacaacaaactacctaattaaaaagtagcacaaataaacttttccctatgtaaaaaatagaacattgcttagccttttcttaaacccctccccaattcttaccaagaaaggataaatacctttattatagtcaaagctctgtttttatggtttttgaattttttaatctaaaattcaaagcaaataatcaatctttaatttatatttatcccaatttgattcaaagtgacggtccaaaagtaaaatgatcaattataactataatcaatcacaaataatgctatgtgagtttgaaatgttaatctaagttgccttttccaggtatgcattttaaaattaaactcttctcagtaagatcaaggctatccttcatggatttatgatgtttgataatcaccacgttgtactgatttgctgtctcacttcactgtttgatatcaacatatgaaagtaaaaatgctatttaggggataactattatctgagcactaataaattaaacgctattttaagccaacaacaaaattgtttagggtacaatttttatttaaccaactgtccattataaacattataaaattctgaaagatcctagaatcttatatagcttttttgtattttttcaaatgtaattgacaccagcatgaattaaatttcatatttaaaaagcttctgactacattacaacatactttaaaattacttgcaagatatgataattctaagattacccacatatcatgcaaatgaaacagccaggtacttcctaccaacacatgatacaataaaatccagaagaacttctgaattagagtgtagtagttgcctagggccatcatacctaattatcacacacttggtgggttaagaggacagaaatatattctctcatagttctgaagcctggacctctgaaatcaagatgttggcggggccacactccccctgaagaccctagggaagaattctccctcgcttcttcctggtttccagtggctcctggcaatccttggctttctttgatttatgactgcataactccaatttctgtctccatcttcacatgaccttgtgtgtgtcttttcctgtatgttataaggacatttacactggatttagggcccaccttcacccaggatgacctcatctcaatcactgggttaattatatctgcaaagaccctacttccaaataaaatcacattctaaagttcctaatggacataaattttggaggtacggtatttaaatcactgcacagaacatgtaaagacaaaaatctggaagctacctgaatgaaaatggatattcccttgaacttcgacaaaatcatattctatttttccatgagaaacattttattaatctaaaacaatattcatatttcacaagtacacctcttaaattatagcttggacttaagaaaaataattagctttggaaattatcagtacatgatatctagtatttcctatatttttaagaacttctacctcctagcaaaaataaacaatgcaatggataatttctgtgttctaaattcacacacacaaacaggaaagggactttaaaaatgatgtgttctcttttaaagcagaagcccaaccacctgctctgaatctaaaagtttcctgaaagcaatgaagggctagtttattatgaaggtgttgatagctgattctgtggagactcacacagaaacaaagaataaattttaatcacacttaatgctaatgtggtagtaaggttgtgacaatattcaaatatgactaatttcattgaattaactacactcgggcttagcttagttgtccaaatttattacaaatagctcaaactaaataattcaactcttctgttttctatttattttttgttgatgcttaagagtaaaaagatatttcaactgaattttttttttttttttagcaatcagttctcttgttttatcaccataagactgtaaacggccgtaacaggtcactgaatctagcactgccttcaacaagaaatgcacctagagcaggaatatagtacttggcactcatctctagacctataacctaacagatttttttttttgtctgtctttggtgaaagtaacgtaaatttagagctggaaaggaccttagaggtcatctagtcccacccaagcatctttgaaaacaaaataaagaagtgtgttggcctgatgcagtggctcacgcctgtaatcccagcactttgggaggccaaggcgggcagatcacaaggtcaggagatcgagaccatcctgcctaacatggtgaaaccccgtctctactaaaaatacaaaaaattagccggacatggtggcaggtgcctgtagtcccagctactcgcgaggctgaggccagagaatggagtgaacccaggaggcagagcttgcagtgagccgagatcgtgccactgcactccagtctgggcaatagagtgagactccgtcttaaaaaaaaaaaaaaaaagaagcatgtttatttcatcattttgtacttatacactgtgtatttccagaaaagcccctgagacagcttagaatgaaaggcacagacactataaaacaagggcaaaatgacagaataatgaagagaaagaggtgacaattacatgggacaacctagggaaggaaacactacccttcagcctaaaatttagtcctaagccccttgttcttaaaggccaaaaggaaaaccagaattcaaataggtattgttagttaataaaatagtatctggatatatcagcaactattttttggtaactctaaactcaagcaaaatatatgtcttcaagcaacagacaatggacaatataataaaaataatcttccatagcaatttccaaacttttaaagatgtaagaacaaatgatcttttcttacaggatgcttagttgaaagctgcccgcatgatggtattttaaactacatgatgttaaattccctgcatgatggtattttattgggacctggttatatgatttggtgaagaatgtaacctttgagaacttagaagagtgaatggttaatatttctctgaatttttttgtttttaattgatattttattttatccctcatagacaatatatgcctgggaaatacactgaagtatagtaaaaaagaatctaagggttaaagtgttgaggtaaatgagaaagcagaggttgtgtctgaagaaccgtgtggtcgcactgcaccacacagcaaacagaaatatgggtgagcacaggccgggcgcggtggctcaggcctgtaatcccagcactttgggaggccgaggagggcggatcacaaggtcaggagatcgagaccatcctggctaacacggtgaaaccccgtctctactaaaaatacaaaaaattagccgggcctggtggtgggcgcctatagtcccagctacttgggaggctgaggcaggagaatggcgtgaacccgggaggcggagcttgcagtgagccgagatcgggccacaccactccagcctgggggacagtgagactccgtctaaaaaaaaaaaaaaaagaagttcaccctatgcaggcactataactacgagtccctcccatctgagccttgccttccagacaaccccaccaatacataagacagaaaaaaagcaccttgcaccttccagactgacttgtttgccagccgcatagcactgagtcaccctagttaatgatatgagagaggaagaatcactcagacgaatcctgctggaatttctcacctataggatccatgagatacaatgaagtggtcgttgttttaccttattaaatttggggtagtttcttttttcttttcttttttcttttttttttttgagacggagtctcgctctgtggcccaagctggagtgcagtggcgcaatctcggctcaccgcaagctccgcctcccgggttcacaccattctcctgcctcagcctcccgagtagctgggactacagtcacccaccaccacgccaggctaacttttgtatttttagtagagacggggtttcaccgtgttaggcaggatggtctcgatctcctgaactcgtgatccgcccgtctcagcctcccaaactgctgggattacaggcgtgagccacggcgcccgggccatttggggtagtttcttaagcagcaatagtaactgtaacactgactcacttctactgccaccaatcactatcctcctttcctgatttacttcctcgtatgtaccatcttttaaaaaacaaataattaggccgggtgcagtggctcacgcctgtaatcccagcactttgggaggctgaggtgggcggatcacgaggtcaggagatcgagaccatcctagctaatatggtgaaaccccgtctcccctaaaaatacacaaaattacccaggcgtggtgaccggggcctgcagtcccagctactcgggaggctgaggcagaaaatggcgtgaacccgggaggcggagctttcattgagctgagattcggccctgcactccagccttggggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcggatcttatatcatcgccgctctggtcgaattcgcctcagcctcccgagtagctgggactgcaggcacccaccaccacgcccaggctaattttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcagtttgggaggctgagacgggcggatcatgagttcaggagatcgagaccatcctgcctaatacggtgaaactctgtctctactaaaaatacaaaagttagcctggcctggtggtggtgggcgccttaagtcccagctactcgggaggnttgtaaaaggacggccagtagaccggcagatcggatatcatcgccactgtggtggaattcccacaccactccagcctgggggacagggagactccgtctcaaaaaaaaaaaatttaaaaaaagaaaaagaaaaaagaaactaccctaaatttaataaggtaaaacaacgaccacttcattatatctcatggatcctataggtgagaaattccagcaggattcatctgagtgattcttcctctctcacatcattaactagggtgactcagtgctagtcggctggcaaacaagtcagtctggaaggtgcaaggtgctttttttctgtcttataaattggtggagttgtctggaaggcaaggctcagatgggaaggactcttagttatagtgcctgcacagggtaaactttttttttttcttttttttttgagacggagtctcactgtcccccaggctggagtggtgtggcccgatctcggctaactgcaagctccgcctcccgggttcacgccattctcctgcctcagcctcccgagtagctgggactacaggcgcccaccaccaggcccagctatttttttgtatttttagtagagacggggtttcaccgtgttagccaggatggtctcgatctcctgacctcgtgatccacccgcctcggcctcccaaagtgctgggattacaggcgtgagccacagctcccggccaagaaggctctcttaaaaggaatcacttcttgttttcttacaagttataacctcactaccctagagtcacattttttaataacttacgaattttctgaatcttcaaataccctatggccccatggtaaaacatcagatgacatttgcctctcatttaaaccatttttcttttcctctttcttctttatttttcttatactctctcctcatttctttttctctcttcctatttctctttttctctctgcttcttcctacctcccctcgtgactttgtctcctcatcccatcaccgtgctacttagatgccacatcaatttgactagcctcaaatttacaatgaatactttttaaattcatgcttctgaaacttttaaaggatgaagaggtataaatgtctcaaataataatttgcttgatggctgaaatgaatggcatttctcaaaaaggccaagggactgaatacagaaatttaaacaataattttccgttagtgatacggtttggatgttttgtcccctccaaatctcatgttgaaatgcgacctccagtgttggaggtgggcctagtaataggtgtttgtttcccaagggtggatccccatgaatggttttgtgctgtcctcctggtaatgagtgagttcttgctctatgaattcacgagagatcttgttgtttaaaagagcctggcatctcccttgctccctctctccccatgtaatatgccagctccccctttgccttaagccatgattgtcagcttcccgggcctcagcagaagctgagcagatactggtggcctgtttgtacagcctgcaaaccatcagcccaaatactcctcttttctttataaattacccagtctcaggtattcctttatagcattgagatggactaacatagtcagttttgacaacatgaacctttcatattaaaatttaatttctaaattcactcatttactgtgattggtttatagcttttctgtaataatgaattttacgtgtgactttcaatgtgctttaaaacttgattcactttttagctctatttttggaaactaccagcttccactgttgaggcaaaagtgtcatcattgaggctctcctgctgaggtagctgttgtctgatttcccttcagttctactgctgtcccagtggaaaaagggaatcttcaccacttacatgacatgtttgcctgaactctaatcttccacacttgctgtagaaaagagtaaagtggcagttcagggcagtttaccaatttagaaacggtgtccgctcagtattttcctctgtgtcacttactaaaacatataaagaaaccatggacattaaaagaaagagagaggtttaatgtgatattttaattctaacaaggatttatgggcacgtgaatgctcaaaatcacatactcccttagtgtttttcatctcacacatatcacatcagacacatatcacacacatcaggcacatatcacacagaacttgccataattaaattatcagtttttgaaaaatattatcatttgctctctttttttctatataaataaatttttttaaaatatgattttcagttctgggatacatgcaaggaacatgcaggtttgttatataggtatacatgtgccatataggtggtttcttatttgtgctttcatcttatggctttggctagaactagataataaaagtatgcatcaatttaagagttatttttaatcatggtaaggacatatctataactactttgttaaatttcatcagtcatgcatgttaaatatcattaaataaatatcaaaaatgggctgctgtaccagaataccatagacttggtggcttataaacaacagaaaggaatttctcacagttctggggtctgggaaatctaagaccaaggtactagccaatctggtgtctgggaaaaacttttgttctagttcaaagaaggctgccctttctctataacctcagttggggaaggagcaagggagttcagggggctgctttagaagggtgctaaacccattaatgagggctgctctctcatgacttaattagttcccaaaagccccaccttcaaaaaccctcacattggcggttagcatttcaacatatgaatttgagagggatgtaaacatttagtctgtagcagtaaatgtacaatataaagtaaatagctttattgttgtgttgcattatattaatatatattttctagtattaaatctttgtatgccaaatcactggggtgggtgatttcttagtaagtgtagaattcagttcctttttctttcagttaagaatattttaactatgtttataagggatactgtttagtaattttattctttttgtattcacttcatcaagagttagtaatagttatatttgctttgtaaaatgaactgaaaggaagccactttttataactttatccatatttcctagtttggggtccattttacaagatgttttaaacagatgcttattaaaaacaccggttatagggactttaataaaaatttttaaaataatgttttacatttcttgcaaaaattgatgcctgcaacctatttactgtttttaaaattaaattaagattcatttaagcagtacatgtttattttagtgaaacacgtatttaattttctaagatagtattttttgtctttaaaacaatttctgcatgttttgtttttttttcactttaaattttatgttttctcagtttttgttttatcacatttgctatatttttctgtatcatgggttatttgttaaagaatgaacttgtgtatgtttataaattgttactgtttttgtttataatttattgccttctaacttaatatgtaattagcattccttttaattttgcttgtatgctttgctgtaccattttgaaattcttgagttaaatgcttaactattttttatcaagtttaaatattaaattaaatatgtcccatcagtttagtcattttaatattctcactcatcagacattttttgggaacaccatatgccttttcatgcagtcagtttcaagaaaatgaaaattactttttatatgtttatactcaaagcttggctagagataagtctccccttccttaagttggggagagagtgatttcttccaggctataatcaaaagagatacaattatagtaactttttgtgtttgtttgggttgtttctgtttgtttgtttgtttgtttgtttgagacggaggttggatcttgttgcccaggctggagtgtagtggcataatctcagctcactgcaacctccgcctcctgggttcaagcaattctaaacatattttagcacaaaactatttaagatttcaatttatatctttttattatcttccatatactcttttgatacattacccattatgttgattattaacgtacactcaagtcaagatcttttattatgtgaggtcatcagtcaatgataacagatattgatgaattagtctcctcatcagaaattgagcaacattttcattcaagacgacacatgggcctttaaagcatattcaataatactgagtctcagtgttctcctgctattttctgaatgtgcatttagacctttatacatctatctatctactgacccatttattaaattttcagcatttactttgtactccaaggaccagaaccatgtttgtcttgttcactggtgtactcctattgcaaggacctagaacatagtaggagctcattaaactctgaggtttcaaaataagtgaatagaggttgtagcaggaagaagtctaagatagcccctatgaccttcatttcctcatgttaccctgttgatacctcacacggcaaaggagtcttgcacatgtcactaaggctaataatccgtcagccttaagacggggggagtatctgggtaaacctaacctaatcacaccaaaacttcacaatcagggagttttctacaactgagagtagaatgggaagtcagagagtttcagagtccaagaagcatttatagcacccttattgactttgaagatgctttgcttcttcttttgagttcagtttgagattatctttctaataattgattagattttattcttgtaaaaaaagagataatttaaaggaatctatttttaaatactctgaggagggtgatactaggggtgctggttgtcctgttttaactttgtcttaatttctaatgtaattaaattttgagtaggtaatgtgacctgtgtggtttttattttaaaaaatatattgaggttttatataatctatttttaaaatattcaatggaaacttgaaaacatactgtttcacatattctcgtatatatatattaaaaatctttttttatttattttttatttttatttttttttgagacggagtctcgctctgtcgcccaggctggagtgcagtggcgccatctgggctcactgcaagctccgcctcctgggttcacgccattctcctgcctcagcctcccgaatagctgggactgcaggcacccaccaccacgcccagctacttttttgtatttttagtggagacagagtttcaccgtgttagccaggatggtctcgatttcctgacctcgtgatccgcccgcctcagcctcccaaagtgctgggattacaggcgtgagccacttagcccggcctaattatttgttttttaaaagacggtacataggaagaagtaaatcaggaaaagtggatagtgattggtggcagtagaagtgagtcagtgttacagttactattgctgcttaagaaactaacccaaatggcctgggcgccgtggctcacgcctgtaatcccagcactttgggaggctgagacgggcggatcacgaggtcaggaaatcgagaccatcctggctaacacggtgaaactctgtctccactaaaaatacaaaaaattagctgggcgtggtggtgggtgcctgcagtcccagctactcgggaggctgaggcaggagaatggcgtgaacccaggaggcggagcttgcagtgagcccagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatcatacaaaaaaaattgtactgcaaaaagctatgaatgaataaaacattttattaaatgtatttggcaccttgtatatacctagttgatctaggacagagaagatacttagtaacattcattttttcttactgtaagaataatgacccaggaggcggaggctgcagtgagctgagcaggccactgcactctagctctagcagacagagtgagactccgtctcaaaaaaaaaaaaaaaaaaaagaataatgaatgctcatcagagggaattgaattttattattctaggaaatctgatggaaaaagtgaaaaataaatattgataccatttataaaacaatgaaaagacttataagagaagccatctaggcttttctctatacttaattatacatataaatacatcagtactttacttcaaaaaataagatcatagggtacatttgattttatgatctgaactgctcacctgaccacacaaaacaaatactttaccatgacattaaatagtctgctctctggttgttagtgctggcatactattctatcatatggaaaaattacagttttccttcacccagtcaccgaaagttggatatttaggatgcgaccagtttttcatgataataaagactaataggaatagcagtagacataagatgtttttggcatcttttttttcttgtaatacgttctacatattgaaactaataattgtattttgctacatattgccacgtttttctcaaggaaaattatagctaacagaaagtgtcagctttctctgtgtgttaagggtgtgggtggaagctcggcagtgacgctgagacatattggtatggaacatcattggactctctagagatcaaggtagcagtcctgtagaaatgttagcccgagctgtgtgtcacctgggagtactccaaggacggccaaaagaaatattttagttagaagacaatttataagaaaagtttagaggcttcctagagaggtcatagcatacacaattttatttcatcctttagggcaagccgtatatatatgttctgcgcacatctcctcctgcaccctcctcaaaaaaaaaaaaaaaaaaaaaaaaaaaaaagctgagatctgatgtaaatagatagctgtgaattatagcttggtccttaaggaatatctcagaaacttcaatgttccttcaccccctccgcaaacccttctgaattgagaatgggaaccttggcaacagaggggagtcatgcacctcccttttccatctgtgactctggcatcttcctccaggtcagccatggtgcaaactctcacagttactttctggcagtttcctgcattccaaacctgtttctgaaatgggcaatatttgtccccttgaaaatcacctgtgataaatgtggtatagcccacggccagtgaaaattttcctacagggagacatattcctaagtgttaacattaactttttcagatgtttgagtcagactcaattgccctttcatattatagattgaaaacaacacttggttgatgttagtatatctgattgaggaaatatgagagcctttttaatttagatttgctcgcctagaaaactcactttgaaacttcttggtcatgttatgtttgcttatggcaaagttatcagcaaaaaagtcactgttatgcagcaatttatctttaaacactaaatgacatctatcatttttcaaagaaaatagtgtcagcagttaaaatcctaactgcttgagcactgttagttgacaattataatgccccattgcttagaaattaattgacctactttcaataagaaacataaaaagtaatatcacagcaattttctggatctattttattccaaaaccaataaatgttacagtgttgttaaaagtaatagatttaaaaacattttattttcttaaacttaacaattcaaataacataaaataatattacgtttctattaagtattcatttttatacagaccaaaagttctttagaaaatgtcttcatgtataatataaatttgatttttagatgtgagaaaagcaacaatcataatcgttgcctaaatccacaaaataagtagatattctataatatgtatttcagtaatcacaatgtattggattcaggcagagatgagagacactctgattttagcagaaaaagactgtgttaaattacctctttgccttttctcactctgttcctaggatagcaatataataaatagtaactttagaactgggatacactgagaaaatgtcctaatttaaatctcaatagatgattacacaggtagtgtttacacacacacacacacacacaatgacaggagtttttaaagatattagtatctcggaatttttgaattctgaaaactgtccaagcttttatcattaaatcacttgttatgaaacccattttagaaacacgctttcctatttttaatagcctatgatagtcatacagaatgagttaatcaaaattgattggtcaattgctaattgcaaattctttgaccgtagcatgtcagctgattctatgaacttctacagactctttcccttggtccgggagttgccacaacactctgactcctttccccacaactccattacatgatattgtcacctccccaggcttacgatactaatattccagagagatgaacagtccttgattttgaatagcaatgcagtagtgaccaaaacagatttagttttggttcagaagaaagtgctggatatgccctcagtaactttccatggtcatctaattcagcaattagtttgagtaaattcaatggaaggctgctttctggaatgggtagtgtaatgtactgacttccctattagacatttcatttaaaaaaatcaattgtccgcataaaacaaccatttcaatcagtgtacattcaactggaaaggaaagttagaggactttttttgaaagtaatgggattggggttggccgttgctaatttctttttgattaaagcgtatgtaattgttttgtgttggataaaaatttgactttttatttgcgcggatgctgctgatcttatatgttatcatttcccattcagacttgagctgtttacctgccgggttttctgttcataaaatgttgaaaggacgttaaaatgtagaacttttacattttttatttaggtgactaggacaaattctggtaatttgtaggctacaacttaaatgtatttctgcttaaaatattttgaaatatggtttatttcacaaatgaggttccaaactataaccagctctcactaaattcttatttatttatttatttatttatttattttgagacggagtctttctctgtcacccaggctggagggcagtggccggatctcggctcaccgcaagctccgcctcccgggttcacgccatcctcctgccccagcctcctgagtagctgggactacaggcgcccgccaccacgcccagctcattttttgtatttttagtagagatggggtttccccgtgttagccaggatggtctggatctcctgacctcgtgatccgcccgcctcggcctcccaaagtgctgggattacaggcgtgagccaccgcgcccagccaaaagatcatttttaaattatgtatctgggaatatattatcaaaccaggcctgaaacttattaaaaagatggtaaaatctaatttaacttcatttaatactccttttctcttagtcttataaaagcaaatgagcttgttggcttttcattatgaaaatataattttaatttataagacatatgtaacaaagcaagatagctgctaaattcactctatcctagtaacttcctattgcatacattcatttttaatgtaataagaaaatcctttcaaaatgcttaaaagaatcacattacccaagaagaggctcaacatttctagaaaataaatatgttcttaagacacttaataattcttgaaatgaagacctaattcttcagggctttaaaatatttgatgtgcactctttacatatatagagagtttaaatttaataatttcccttcttaaaaaagaagtgaaacataccacaaacatatcaaagcaagttattcatacttctcatttaagtaactgtattgtcatagcaaaattattttatatcatcaaacagcacaaaagccttattagaatactaatttcaatgtctgtttcacagatttgctcagaatagattttttcatgcttctgcactaattcattgaaggacaatgttttaccgattcctgaaaaaatatcattatctgccccatagtggtggctcatgcctgtaatcctaacactttgggaggccgaggctggcagattgcttgagcccaggagttcaagaccagcctgggcaacatggtgaaaactcatctctaccaaaaaaaaaaaaaaaaaagtaaaaagttagccgggcaaggtggcgggcacctgtagtcctagcaactgaggaggctgaggtaggaggatcacctgggcctgggaggttgaggttgtggtgagccatgattatgccactgcattccagcagtgggtgacatagtgagatcttgtatcaataataataagataaaatagaaaataaaaatatcattaactgacattttaaaaagtatatttcccaatggataaatatactttgtggattaacaagagaaaaatttcaagatactgtaaatttaaaacaaatctttatgtataataccatcgtaatgtctttgaccaggagcaatctatcatgtgagataaaaaatattaaatatgcatttattgaataaatgaatgaaaatcatgattaccttgatcactatatttaaaatttaaatgaagcaggaaagtaaatcttcctaattatcatatacttaacataactgtttaaaatcactctaataacaagtaatatgttaattttgaattataattttaaaatgcctgtattgtttcattcactcatccttccattagttcagtgaacaaatattgattacttacccactatgtgccaggtatcatcatagattcagggagtacaaaaatggttaaacgaagggatcagctggagtgaccgttttctagaaacaatgcctatttcagttatgaactagtctgttttgaagaaagtggtgagggaaagctgaaaatcctattttcactttattcaacaaatcttattgaggtcttattatgaatcaggggctctcctaggtatgggcatacaaaattgattaagactgtgcttgcttgcagaaaacaaacaaaaaagcatctctataataaaaaggaaaaagaggaaattccctttgtaggtttcatagtttatagtgatactgctgatgttgtctcagagaattagtcacaattataggaactcagaaggcattccgttgagatgaaatagagactaaagtagcagagattacttagtgaaataacaattcgaacatagttataattcattttagaagatattatggctcacacatagtagatgtgatgactgaataacaggaatgtggaacgatggcaccttggtagccattacccattgccaacatgattctgcattaaaaaatctgtgcaaaacggccgggcacggtggctcacgcctgtaatcctagcactttgggaggccgaggagggcggatcacgaggtcgggagatggagaccatcctggctaacacggtgaaaccccgtaactactaaaaatacaaaaaattagctgggcatggtggcacgcgcctgtagtcccagctactcgggaggctgaggcaggagaatcgcttgaacctgggaggtggaggttgcagtaagctgagatcgcgccactgcactccagcctgggcgacagagtgagactccatttcaaaaaaaaaaaaaaaaaagaacacaactttggagtatattaataaacattgtgttttttaaaaaaaaaattttaatctttaatttccgttttcacatatttcttcttgcttccaaaaggaaaggagtgggtagctctgttgtacaccgtccacggcccctggatccgggcggggtcccccgggccacctgggggtccacatgcagcccccgggaggccggtgcggggtgaggtccgggggccgccttattgctgaagtccggccggttggggccccggcggccgctaggcgctctggctgcgcagctcctgggagatgaagcggcgcaggcgctccaggtactggctgtagagctggatgtctttgtgcccggcgccctccacccacagcggctccacggccttggggcagcgctcctagagcgccagcccctgcgagaagtcgatcacctcgtctttcgtgccgtggataatgagcacgggcgacgtgatcttggacaccttctggattctgcgggaggggcgtggggcgggtgagacctctccgggcccgggccccgccccgccccagtccccgacccagtccccgtccccgcccctgtccctgccccagcctgctcacttggggaaggcgtcgaagcagtaggtcttcttggtgtcgggaaggcgacgctcaggtccaaggtgagcggcgagtgcagcaccaccgcggcggactcgtagcgcgaggccaggtccacggtgggcaccgtgccgatgctctgccggtacaggatgatgctgtccgggctgatgcggtacctggcggcaccggagcagggtcagccgcggcctccgactcgcgcgcacccctcccgccagcgggcgtccccgggcccagctccagatgcgactctccagtctcccggctcagcctagtcagtgggtcaggcccaggctccacagcagtcccaagggccacccccagtcccccaagaccgcagcggtgggcggagccggcggcgtggtcctgttccctggcgctatggttcactggcgtttcctagccaggatctgctggatcctggctagggagtccccctcgggctagggtaggggaagccctggcgcctctccttctcctggtcatccctgggcgcacactgggaactgtgtgcccccccacatcctgaatgcttcatgccttcctgcccaggttagaaagccgttcctggtgcactggccggaacagggtacactcttcctccctgcagcccttgcccacccccttggccatgaggaattcaggcagctgtgtccccacatgtctccacccaattttggactctcggagtcccatgctcaatgaggtgccagcccaacccaggtcaacatcgagggtggcggctgcgggggcagcacctcctcccaccagcgccttcccttgggagtggacaagtcctcggccacctcagcaccaccagctcccacccagggccacccccaccgccaggtcactggtgtgcggcccctggcccagctggtccagcaccagtaccaaggcctcctcgtgcccagtcccaaccacgcgggacccacctgccaccctgtcgatgccgcaaccccagaactctcctcccacacgctccaggctctgatcccaggcagatgccctcctgcgaggcaggagcatgggcaggtgtgcgtcccatctgcctggcattcggactccaccagcagggctgtacccctccttggcctggaatcccagcctcctggcagcactccacagctcactgttcacccatgccccaaaggatgctgcctggctggtgcctgtggccccagctctgcctcagcctccttggcctgctccctggcagccaaggccagtagtgtgctgagccagcccagccctgtcacctgctccaggcaggacccccagctgccacctggatgtcaccactcagacaatcaaacaagacacatcctcagtggaggccctgagcgcgatctggcctccccctcatggctctgggccgaggttcctgcaggacaaagcagcagcaggacagatggccgagcagacagagctcagagctggccatggcgggtgtgactctgccagtgccctgggcagtagagacaggaggggtccgaggaagctgcatgaagtggtgcttggtttctgcgcccacactgccaggaggcccccagagccagggtggtgccaggggacccagctcccaggcccacagaagggactgcctgggatatcgccaaggcatcgaggaccccacctccccagggcctctgacttctcagagctgcgcctggcccctgcaggagcggggcagaccagtggggggcagggccaggacgagacagccccagcgggtggcaagcaggaaaggcctccagaggcccacgcgggtcttctgatccagagcagcactggcccgggcggtgggcggtgctcaaacaccagtgaagggcccaggaaagtgcagggctggggacctggatgtttaggagggctggatctggaatggaggctggcccagacctcaggtgtgtgctgggggtctgcacctgacccagcaggccctgccccgggatggccgagctccacagccacagggcctcatgggccaggcctcgggacctcgatgcagcagcctcgcctcacctggccccaagtgctgcctcggccattgggctcccagccacacgtgcacagaccccccccagacaccacccaccccctcccgccgggtggcgtccacgcccctgtgacaagctcagccccttcctgtcctcaggccaggggatcccagagagcctggctccacaggccagggtgtggggggacctggccacacctcagccatgtggaggcggcacccgcacgcctgagctcacctttccggctctctggccgcatgcgtccactgtggctcctctcctgcagggccgcccaccttcctcccagggaagcccgcccctccccccggcccccggcctggtcccctctccggtgtgcccaggctgagctgcccccggggtcgccctcacctggtgcgcagggcctgccgggcggcgtcgatgtcggcgtagaggttcgtctcggagggcctgcccgagctggcaccgtagccggagtagtcgtaggagaagatgttgcagtggaggcgggaacacaggccaatgtagaagctgctcatctggcccaggtccacgcgttgccttccttgttcatgcaccgctggtcagacgcaattcagctgatgtaggctgggcttggctagcattggcttgaagctgcagctggtgtccagatctgttccatgtatttgtgatcctcctcagccctcccgggtacttgaagcatgttattgttgtggccaaagtcaggagtgcaacctgcctgtgcaaaaacatgccaggcttctgttgccttaaatcctctaagatacccctttggcttaagcagagtcacacagcaaggatcaaagtcaaggagtggggaattatatctgtcccttagagatggagataggagagagtgtgaacaaatgcaggaaaatgatctcatctaccagagtgtccttaaagattttaacataataaattcagtattgtttttgtttgtttgaatgaagctttgcatggacacagtacagtacaaaagtactatttgaactctttctccacattcataaaattgctacatagtttctaccatgattatatttttatgatccatttttgtgtacagatctgaaaactttatactagaatttattagctgaggaaaggaacatgcactgacatcatcatacacaaatatttctcaacattttaatgcttgtggtattgttaatgtttctgtggaaaattacttaaaatcatagaagtgatttctaagtcagttattgatttattctgatgaattataaaaatcagactaaattagtaatagagaaattacacttgaaatactagtctgagctacaaatgagatggatttttgtgctcatcatttgtactctagttatgtttgttgagattgggttatgaaaacatcattataacattatcagcagaaaagcctgttgtgctataattaaatcatctaaacaatcatttttgtggtcttaatatcctggatttctcaattgattgtagtagataagagttctctttaaatactacttattatcggtagcttgcttttctgtgaaatctagaaaatttagaattctgcattaacatttaataaaatacctgctatcctaatattgatgcattatatttatctatacaacatgcaacaggagagaaatatcagatgaattagaatatttgcagcctatggcaattatctgtagccacatttttttttgtcttcagaaaaatgtagatgattttggaaatggattagttctagtctcaatctaggaagaattacttatggaagttttgtgtacaggatactgatgttttcaaatataacgcattattattttagtttagtttcttttgccacatacttagaaattgttcaagtgaacaggctattaaaacgaatggtatagataaatggtatagataggcattgtaaacatcccacttttcccaagccatgaattttaacactggattaaggagatgaaaatggagccattgggaatgtggattctttgctaataattatttttcttctttaaaaagattcttcaaaaggcaagaacatggaagtatttcaggagatattcttgaggtatctaaaatacatactcttcctatcaaaatcaataaatagatggatgtaagtaagataaagtcagggcaactgattttgcatgtgagtgtacacacagacacatatccaggttttctccatctgttctcagttgctgaattattagactcagctgaccgcttgactgtgtttaatctgataaacagactcttaacaagaagaacaatgttttaaaaactggactgttcctcctacttctcagcatgcatcagccactctctttccccatcctatctcctgccaaattggtctctacttatctgttccacttggagacactatttgatgttgttgtaaatgacataaatgaatattcactctacctgctttcatattaattcagttttcataggatggtctctgtgggatcaagcaaaaggacttagtggaatatctcttatgactccataaagtaaagaatgtggtgagtttagcagagtgcaccttcctttactaaatgtgaatgatgtgtcagtatagggggccagagtgaaaagtcctaacatatgcttgtttgggcagccaacaattggtcacattgcacatttcatgttacaaaggagcctcatggtagtataaatgagggtcaggaaaagacacttaactgtgctctgggctttaaaatggagccagggcaagaattctggaatttgacaatgtcaggaaggaaacctctgtaagcaggcacgcaggggactccagaaatctcttctttgccactacaactctggactttcagaaatacacaccccattctcctgtattaatacacacttcatgttcacaacatcaaaaaccaattttaaaatagtaaacctaaggtagatggaaaggcattatagcctcagcatgcccgagatgtgaggagcaaatcagaaagatgtgagtgtgacgagaaagggacatcgtgctaaccaatcatttaaaatttttactccaaagaaatggcaatatttcacaggttttttctcatcaccaatctcacaaatatacatgttttttgaaaattttcctctcaattcttctccttgacagtgaagtccagaagaggttggtttagatctaactcttttcagcctcaatactccataatcactttggcttttttgattatgactggacggcatgtactattattttaatattaaatatttaggaaataattttaaatgttatccttaaataactatgggctttattcatttactgtatgtatttctcaaacattcataagaacttaaggattttaattcaaatggtccctaaagtagaaaatgcactcacagattctgcatatgtcttttaagaaacagaaacgtgccatttgttattaaattgagtagactttgtatcctttagaatttgggcagagttttcttgctatattgtagagaacctatcaaccatatcttaattttcttctttttgaggtcttcaaaattaacattggcattggtccactaattccttgttttctatttttggatgagtgtgcatagattacctccatcttaattttcaacataaacttttagcagactctttcacctttcattgccatgtaagcagatgtgatttttattcttttttccttttcattgaacagttacttcatttgaaatttttcacttgatttaatttaactttattttttggtggtagatacatctgttgccacctgtgtctggttggcattttaatgtgttgcctcgaagctgtaaccacaatagtggcacattttcctgctgttcctttattctttgttccatgtgtatctattttcaataaattgcattggtatattatcatagattttctttttgtctctcagattttctgttgtaattatttttatttatgcctttggaaatattttatgattgttacataaaacagcagagctctttcagaaagttttcatggttttccaaatgtacattcatatagattatttagtagttattacacaatgatctttggagcaataaatgctgttacgtaagaacaattcccaaatgtaatttgagttataagctagcctttgatggcctagaattgatgtacctttataattctaatctgcatgcaaatttaagaagaccaaggattgaggattgggtgcataattttcagggcccagtaaaaagtgaaaatgtagaaccctttgataaaaacttacaaagaatttcaagatgaccataataggccatgcacaaggcctttgtagatgggtagagtgaccatgaagccatgggcattgtttggttttgtttaatcttactgtttggttgtaaagcagatttttaaatcaagagaaaaaagaacaccaaagaagatctctgtcaaaatgtttgaagcattatagaagattagatccatataaatgaaagggataaagaaaaagcacatatccaacctcaaatataaagcatggaattctcatatgaactccattatagcacttgatatttcagctctattttcatttttgaacaactctagatatatctatatattttagtctaaaatttaatttttataaattgtaagtacttccccaaattctaccttagataaacaattcagagataactctgtttcctattctattaggtggaaccatatgaaattgtcagtattcagccttttttgtcctacaaaaaaatgacagttttgtgtttccacctaacacatggcagcccaataaatatgtgaaggtcaggaccacagagctaccacactaaacaatactaaatgcatacacataccctttccaaaacccggcaggtcttcttttccccaagtgaaacattctttgactcttcacccattattcatgtgagaaattttccaggcacttcaacatgtcagctcagtgactgtaacaattaggtttattaattctcctctcacaatttgacattctttattgaaaagcatgatttaaatgttgactaatagtctgcatagtgaaacatttttactagttccaatgacctaaaacagtgtaaaccatgattcagaaatttattttcttaaaaacttctaaacaaaatgtctgctaggataaaccggtgcaatttctatgtgaaacctaagaatttcaatgacacattttcatccttattgccatcaaataatccctttaatagtgccccatctttcttactccttcatatgattttctatattattattttccatcactcattctgttaaaactataatagtttcttcagagaaatgacagattttcccacttcagaggcatttctgcattgagctctcataaacctctctaacatggtgggcaatagactcaataacatttgtgtataaactcagttgtgaattacaaaaggctcatctataacgtcaaaaagcaactcggtaaaaacaattctattgaagatagtatgatctaaatatataattttaggatggcttcaactgagacaaaaatagcatcgatacagtgtggagcaatgaatttctaaaatttttatcagcttaacatttttcatcagcacaatttatacagaagcccaacatgagacattcttgttcacatggaatttctctgcccgctggagccctgtagaaatcccactgtgttggtaaacagcagtagcaacaagaagatactaaactggaattctcagtggctcaaccaaaccaaagtttgttggttgctcccataaagttcaatgtcagtcagaataaactcctctagccttaacctatgacacacatggcacataaccttccaagtactggcagtggaaaaggagagaacttgggaatgaggcaggggcttcatggtgaacatggtgaaacctcatctttaccaaaaatacaaaaattaggtgggtgtggtggagtgtgcctgtagtcccagctactcaggaggctgaggtagaaggatcgcttgggcctgggaggtcaaggctgcagtgaaccaaggtggtgccactgcactccagcctgggtaacagagtgagatcctgtctcaaaaaaaaaaaaaattgtgaaggtgaaatttaaatacctttgtgcatagctatcagttattctttgttttaatatttagtttattgtgaaatataacacgtatagaaacatacataaaacaacacacagggccaggcccggtgggtcacgccttgtaatcccagcactttgggaggccgaggcgggcggattacttgaggtgaggagtttgagaccagcctggccaacatggtgaaaccccatctctactaaaaatacaaaaattagtcggatgtggtggtgcatgcctgtaatcccagctacttgggaggctgaggcaggagaatcgcttgaaccagggaggcagaagttacagtgaaccaagatcgcgctactgcactccagcctgggcaacggagtcagactgtgtctaaaaaaaaaaaaaaaaaaaaataggccgggtgtggtggctcacgcctgtaatcccagaactttgggaggccgaggcgggcagatcacttgaggtcaggagttcgagaccagcctgaccaacatggagaaaccccatccctactaaaagtacaaaattagctgggcgtggtgttgcatgactgaaatcccagccactttggaggctgaggcaggggaatcacttgaatctgggaggtagaggttgttttgagctgagatcacgccattgtactccagcctgggcaacaagagcaaaactccgtctcaaacaaacaaaaaacaaaacaaaaacaaaaaacacagtgtaacatgttattatgaagtcactgctcagggaccaacttggccgctcctgtgcctctagagggaagctccttcccactgttctttagagttttatatgttaagtacaggagtcaacaaactaggcctatgcaccacatctggcacccagcctttatttattttttgagatggcgtctcactctgtcatcctggctgcagtgtggtagcacaatctcggctcactgcaacctccgcctcccagattcaggcaattctcctgcctcagcctcctgagtagctgggattacaggtgtgtgccaccacacccggctaatttttatatttttggtagagacggggtttcaacatgttggtcagtctggtctcgaactcctgacgtcaggtgatccgcctgcgttgccctctcaaagtgctgggattacaggcatgaggcatgatgcctgacccagccttttctaaaatgaaggtttcggctggcgcggtggctcatgtctgtaatcccagcactttgggaggccaaggcaggtggatcacctgaggtcagtagttggggaccaccctggccaacatggtgaaaccccgtctgtatcaaaatacaaaaattagctgggcgtgatggcaggcacatgtaatgccagctactcgggagcctgaggcacgacaatcacttgaacccgggaggcggaggttgcagtgagccaagatcacacgattgcactccagcctgggcaacgagcgaaactccatctcaaaatacaataataaaaaaaaggatgtccttttttgtctctcaaccccgttttttatttttttttattttcagacagggtctcactctgttgcccagggtggagtgcaggggcccgatcttagctcactgcggcctcaacttccccagctcacaggatcctcccacctcagcctcccaaacagctgggaccacaggtgggtaccagaagttattaggatagagtgaatttagcagctatcttgctttgttacatatgtcttataaattaaaattatattttcataatgaaaagccaacaagctcatttgcttttataagactaagagaaaaggagtattaaatgaagttaaattagattttaccatctttttaataagtttcaggcctggtttgataatatattcccagatacataatttaaaaatgatcttttggctgggcgcggtggctcacgcctgtaatcccagcactttgggaggccgaggcgggcggatcacgaggtcaggagatccagaccatcctggctaacacggggaaaccccatctctactaaaaatacaaaaaatgagctgggcgtggtggcgggcgcctgtagtcccagctactcaggaggctggggcaggaggatggcgtgaacccgggaggcggagcttgcggtgagccgagatccggccactgccctccagcctgggtgacagagaaagactccgtctcaaaataaataaataaataaataaataaataagaatttagtgagagctggttatagtttggaacctcatttgtgaaataaaccatatttcaaaatattttaagcagaaatacatttaagttgtagcctacaaattaccagaatttgtcctagtcacctaaataaaaaatgtaaaagttctacattttaacgtcctttcaacattttatgaacagaaaacccggcaggtaaacagctcaagtctgaatgggaaatgataacatataaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccagctcctgcatcttatcatcctgctcaaatatcttatactccagccacatcaacacctctgcctgcttgacaaactactgctccagaaacaccatttaatccttcagatactgcatcatcacatcctatggaatcaactgctcctgctgcatctgatcaaacacaatacacatcttatacattctggatatagagaagcccatttgaactcagacactagggaaaaactaaaggagaagttataacttgaggtagccttggatgtattgaggtaagaagaggacatctatggtatggttaatgagaacttcagggcaaaggatgtcatcccagcaaggaaaacggcaaaggtacgtgaacaaggcagacagggagaacaggcctctattcacaaagcagagagtacaaacgttggaaagcaatggatagagggccacaccctgaagattccaccctgaatgttgaagactctccactgagtgatataatgggctctggaaattcataagggggaagttggcaggtgggtgtggaataaaaaagctacatgtttggtacaatgtacactactcaggtgacaggtgcaataaaatctcagacttcaccactatacaaattatccatgttacctaaaccacttgtgctccaaaagctattgaagtaagacatttatttatttatttatttatttatttatttatttatgtttatttatttatttttttgagacggagtctggctctgtcgcccaggctggaatgcagtggcgcaatctcggctcactgcaagctccgcctcccgggttcacgccattctcctgccttagcctcccgagtagctgggactacaggctcccgccagtacgcccggctaatttttgtatttttagtagagacggggtttcactgtgttagccaggatggtctcgatctcctgacctcatgatccgcccgccttggcctcccaaagtgctgcgattacacgcttgagccaccgcgcccggccaagacatttaaaaaatgaaaacaaaacactatcacctgagtaatttgtttgcttacattaaatatcataatacttttcagcaaaaaatattatcattttaatgtaactttcgttccctgtatttgagcggagtactgcactatccataaacaccctctgaattttctacagtaatggaaaaaaatctttgaaaaaaataaaagaaggttctatgtttgagaatatggctatatgaaaggggtttcaagaaatatccagttcttcccaagacgatgtacttccagtgaccagttttaagaagtggaacaggccaggcgcggtggctcatgcctgtaatcccagcactttgggagtccgaggcgggcagatcacgaggtcaggagatcgagaccatcctggctaacacggtgaaaccccgtctctactaaaaatacaaaaaattagccgggcgtggtggcgggcgcctgtagtcccagctactcgggaggctgaggcaggagaatggtgtgaacctgggaggcagagcttgcagtgagccgagatcacctcactgcactccagcctaggtgacagaatgagactctgtctcaaaaaaaaaaaaaaacaaaaaaagtggatcgaatatttcctaacgaggtccttcaagtaataataagtgattaaactttttgataatgataatatcaattggacatgataaaaatactattaataaatcttttgatttaaaaactaaccttgtacccacttcttttgtaggcgtggggggagcttagagttaagtattccagtatccgttagggatttggcagtatacatcaataacaaatagtagaaggaaaataattatacctgtgtcatatatatatatatatatatatatatatatacacacacacatagagagagagagagagagagaaaccatctcttaaattacctgtagcaccactatgttattctttactctcccaataccccaagtagattgcacatgtgactcttttattaatgtgttgaatattcataatgataatgaataatatgaataaataaattgataagtgcgtaactatgaattaggcattgctttactcttatctggagatttcaattcatgataaacatcttttagtgaccatgaataagaaactcatagacctgcattagagaaatgcaaatctaaaccacaatgagataccatctcactccagttagaatggcagtccttaaaaagtcaggaaacaacagatgctggagaggttgtggaaaaacaggaatgcttttacactattggtgggagtgtaatttacttcaaccattgtggaagacagtgtgtgaattcctcaaggatctagaactagaaataccatttgacccagcaatcccattactgggcatatactcaaaagattataaatcattctacgataaagacacatgcacacgtatgtttattgtggcactattcacaatagcaaagacttggaaccaacccaaatgtccatcagtgatagactggattaagaaaatgtggcacatatacaccatggaatactatgcagccataaaaaaggacatgagttcatgtcctttgcagggacatgcatgaagctggaagccatcattctcagcaaactatcacaagatcagagaaccaaacgccgcatgttctcactcataagcaggagttgaacaatgagaacacatggacacagggaggggatcatcacacactggggcctgtggggtgtgggggtgtaggggagggataacattaggagaaatacctaatgtaggtgatgggttgatgggtgcagcaaaccaccatggcatgtgtatacctatgaaacaaaactgcaagttccgcacatgtaacccagagcttaaagtataatttaaataaataaataataaataaataaataaactcatagacctcaaagtatgggaagcctaactgcctacggccacttgctgcttcactctaaaatctgtttctgcatctgcccctcagtcaatgactgaggcccacagggtggctaatgcagatccctctttaggagacacagggcttctctgaggaccagtcttggctcaggattccctgaagccttttctcacccttccttagactgtacattacgctccagtgcttccactcaaccttcctttcctctttccttcattctaggtcagacttgcctcatagctgagacctcttccaggcttactcagcttcctctccattttctctcacagggatttcccttaataaaatcctcttgtgtttaactcgttttcaacatctacctcttggaggacctggactaacccaccacataatgtttgtattataattacttccattctacaggttgagaatctgggatctggagaagttaagcaacttaagttactcaagtaaggccacacaacgtatataaagtgtgctgcaaggagttaaacccagggaacgcacactccaaaacagaaccatcaacaagtaccaatcctgaaaccaactaataaaaggtaaagatacaattagcttggtgcaaaatgttatttttctctctaattacattttctaaggtttcactgtttgtgattaagaagggatgaatgattttcatcaaaactctgctcaacaagccgggtgtcgtggcatgcacctgtagtcccagctactgaggaagcagaggcagggggatcacgtgagcccaggaggttaaggctgcagtgagctgtgattacatctcgttgaccacgtgaccctgagtgtaactcatagacctcaagcctgggcaacagagcaagactctgccttaaaaagtaaaactaagcaaaacaaaacaatcctgaacaaatggttgcacataaccagctaaacagtaatataacagttgttggcagggtgagaagaaactagcagactgtaggtttgtcatactgtttttttgtttctccagaaacacagatataatataggcaatgaaagctgagactcatctcttaatttcagttaagctattaattgatttacatcatttacttacaggtcagaaaagttcctttcaaaaggcaggaatgttgtttcatgttaatctaaggacttgcttaccttttgtttctgttcttaatgatcacagttactaatacagttaaataatatttagataaaatacattacaattatagctgatcaaaaatctcattccaagctgttatattgttgactatctcatgatcactcttcttatgaatcatgtaaatagggaaaaatactgcaaagtagacccacgttacttcaaatgaaatatgatttaataaaatcagttattctttgccaattttgtaatgttcaaaataaccacaattgaaatagtgatacatacacatcagaacagttcaaatgaaaaagagaaatgataccaagtgttggcaaagatgcggagcaactagaactctctcccattgtggatggaaatgtaaactgatggacaccaccattttccatgtatgctaaatctgaccatattctatgaccctgagcatatacccagcaatatttaccaaaagacaaatacatgaatgctcagagaggcaccattcaaaataaccacaaattgaacttatatttgtataatgatatagtatatagcaatgagaacctaacaaattacaactatatgcaaaaagattaacaaatcttataaactaaatattgaatgaaagaagcaagatacagaacatattctacgatctaattcactaaaaattgtaaaactcatcagttatgttccaaatcaccataagagcgatcctatgaaatagtgtctagaagaagtaataatataaaatttcctgacttgagtactggatacacagaagggctaagtttgtttaaaaacaaaagaagtattgagctgtacagttaagatttgggtattttactgtttgtatgtattttcagcgttagaaaattatgttaaaaagtctttatgctctttttcttaatatatttacaatagacaaattttcattaagccacagtataaataaaaaagacccacacaggtatttttaacatggatgaagtggttctgtcatcattaaatgagtactttaggatgcaagtctgatataaaaacttacttccctgaagactttaattttgcatgcaaaatacacggtttctaaattaaatttttttgtaacaaagcgtttttgagttcccctcatggaattttaataaatcattaatttcttctttttctctttcatgcacaagcagtggataaacatttcaaagatccctacagaagtttcttcccttgaaatactgttcacatgacaatgagaaggatggaataaaacacaaaaaaggtaagcaattttttttttttgaggcggagtcttgctctgtcgcccaggctggagtgcagtggcgcgatctctgctcactgcaagctccgcctcccgggttcccgtcattctcctgcctcagccttcgaagtagctgggactacaggcgtccgccaccgtgcccagctaattttttgtatttttagtggagacggggtttcaccgtgttagccaggatggtctccatctcctgaccttgtgatctgcccgcctccgtctcccaaagtgctgggattacaggcttgagccactgcgcccggccaacaggcaaatttttcgttggggaagtagtagaccaaccatctgtgcttatttcttctaaacagagctgggaatgagtgacagcagttgaacaggaacacttgctccccaagcactacttgtttttcatgaagaaggaaaaaaggcaaaagccctgctacatttacattcgcaaaattgttttcaaatgaggattaacaagatgttagttccctctctgttgaacacataaaatattaaaaggcagtgctaatacatctatatacagcacatcaggaggaaggaggaagtcatttctcctgactttaccaacttgtcttatttgaaactgataccgtgccctattggctgataggagtttcactttatttagaatacaatagaatttggctcagattcacaccaaaagtatagtattttgatgtgcacttacacgatttcaggggaaaacaatatctggaatgtgaccctggaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcttattacaggtaggaaactgaggttccaagggggtgggaagtcctcctaagaggaggggtcagactggaagctacacaaaaagaggcagaaatgtccctccgcctcttaatcggagcctggggaaacaaacacactcgtgcaaaatctccaaagaggtgagctcttcaccctgtcaattttatctgcctcgtgaaccccagggctcaggctccaggcccgggctagctcacacaacagcagaagggccttaggtctgggcactgagccaaaaaaagggaggctgtggtccctgctttggttaccctgccgggtctgagcgccaaatcggatctcctacttctctctccctccctccctctgttcctggactgggggcaggcccttctgctaacagaaagccttccagtcggagaaagctctggcagcctgccgcgataaagggccctgggggcgtgaggagagcaaggggctcaaaatcagaacccagcgtgacgacagtgcctccatgactgtgctcccgcaatgcgcaggctccatgtcctggcgcccgcccgcccatggacccggcgggggcttccaggctgggctcagccattacgccggcgtgcgggggaggaaactcgcctcccgggcactcggttgtctcctgcccccgcccctccctccgatccgggcccatctctgacgtagtgtgaccttgctcatcccttccaggctgtgggcctgttttccctgtgcaagatgagggtcctggctgtcctgaggacgctgtccgggcgccgccaggggtgaccgaattcagctctgctaagactgttgggaaatgaactccctgtcggcgtgtggcagcccgcctgcgccaagcgccacaggaaaagggggcgctcctgtccctttgccgccccccaaaatttttctgggaacggaatccactgactcgcccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccatcttgaaaagataagctttctgtttgtctttaaaatatgacccacaatatgcctgtttttaaacagtgaatgatgctctaaaatcacaatataaattcaggcagtgctccttacatggaaagtttaagtacttctaacactgctctttttcacttgttatgaaaacacagaacaattatctaagcatctaattattcaggtcctttgtttctcctccaatctattagttttatagtaattttagggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttccgtacctatttttctccataaatccactgagaccaatgtgtggctctatcgcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattattctgaaggctggttacgggacacattaccttcatactttgctgtttaagaaatgtggggtggagaatcaagtaaactgatagaatttccatataaaattctaagtgctctgagaacaaaagaaacttaaaatacacacacacacacacacacacacacacacacacacacacacacacacacggttttccctactaatcattttacaactaaacaaccaagttgctaaaccagagcccacaaaagcagagtcaaagttctaacacttggtaaaagaaaaatgcacacatacccctgtgagctaaaaaaaaatgcttaagtattcaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacagccgttgaaattggagattggaggctacagtttattgagacctggtttggtgctgttagggagctagaaggctgactgcagggcctgaagagtgggagagacagctcctttagggcctgaagagtgggagagatgtgaggatggggagacagctctttcaagaaattccgctgcggttgagaacagagacactcagtggggtcgaatgagggttttgttcccatagtagaggcttgaacacatttacaggccaatgggaaagatccagttgagagcgggtagttgagccttcaggagagaaaagggatgttccatggggcaaactcctgagaagggggaggagatggaaggaagcttctgtggatgtagcagatgcaggagggtttgtgtagttttagccgggctcgagccggtggctgacgcaggcaggaacaatggctcacccatgttttatgtgtatttccgtgtgcgtgctcctgctttccccaggtctgggccgcctgcctggcccgtgtgccgtagggaatatccacactgggcctgggcggaggctgggcatctcccgctctgggcttgctccctgatgagattctcagaccgtgcttcccctcattcatgagaggaaggttcacagagcaggcgtgggaacctgcctggccgccagggcctcctcccgctcaggctgaggtttgctgcatctctgtccttattcccttccagactggattggctgaaccaggtgtccactctttttggcccatggcataaagaagggtttgggcaacccagtgtgccccaggttgttaccgcccccccgcctccgcccccacccagcctttgatgggcccccttctcatcaatccatcacccctgcacatgccaccaggactgcctggaccagagcccgggactctctgaaacccactgagagctcggccctgggaatgggcctcccaatctcggtctccagggggtgggccccaggtccctagtcttcctcagggtcttctccactgttctgcctcctctcctgatacccagttcctagccggggtgaccccagcctcccgtaacagcctccttgtggtggtgctgggaagaaggggcccgtgtacccggcagggccccccaggcaatgggcatgagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatgttagccttctcagtaacacagccagtgtgccccatgggcatctgagggtaggctccacacaccagatgtccacaccttagtgctcagcacaaggccagacacaatgtctgatgaccgctataccgtgctgagggaaagggataagggactagcagaggccactcaggtttttcttgggaggagcatgaggcagaggagggactagcagcagggaaatcctacctgcctgaccaatagcaggcaacagctccatgaggatgctctcctcagaagaaaggtgtatcctgacccaggtccttaccagatgtgaagcagcaaaagcgggagaagtgtgtgtgcatcctcattcctggaacttagaaaacctgccactaaccacgcagggtgctgaggggctacagcccctgcctgccaactcaccctgtgctcagagaggtccctgagggccagggcttccagctggggtttcgccttctgtgcttccttgcacccaatgagcctcaggaggccatctgctgtcttagagaaactggggcctcaggaaaggaccccaaacctcacaagtatatggtacggcagtacacctcctgatgcctccagaagtctgtggccagggaacagacaagatttggccccgccctgcccagtaacaaggtccctcacacccctcctcccatgcctggcaggaaggtgactcaggcagtgcgtctgggtagcctggggctgcgcttcccccaacgcaacatctaggttcttaggaaacttcatttgttgtgaaaatcggaaatgaaaagacagttggtgacaaactcctttctccatcacctccttattggacagaaacgacccaggaatgcgcctcgcgtgagtcctattctttcttggggtgcacacccgctgctggaagtatgaacagcaggtttgagggggaggggagcgctgacccgggcactgcgcagggagtctcaaggggggctgacgcagagggagggtcaggcactcccgggtcaacggtctcggcctggcacccacctcggtcacgacggtggacaggtagacgtcctggctgaactcccagccatccaggcagctctcctgctccagctgccccaggtccacgtcgcgccccggctccagcccgagcgccgagaagttggcgatggtggcgagccggtagcggctgcagctgtggggcacctcgcggccgtcccgcagccgcagcgggacactgttgttgcgccaggcgctgctcaggttcgcggcgtccggcactcgacagcggtgctccggggtccccgccaggaacacgactgacataccattgaagccattggggatgatgctggcgctgagcaggaagaagatgaggcgctggaagggcccccactcgcccaggaaggcgatcacctcgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgttcatgttcccagggtaccatagcagctctacagatgatgcttctttcttcccctgagaaaaggatgcctaggatggacattaactcagcccaagtatatataactgtggtcctagaaattggttaattcgatctgctattccactggagttgtctaatagtgtggcttgaactctgtttttaggttttggacctccgagctggttaaaggagcatttacaaagtgaatacctcctcctcgtagggacacctctcttcaggggaagagaggtggagctaattctcccgaggtagaggggaaggggaagttctgaatatcccttttacattgctctatctcacactgaagtcctttcagggaagagtacttagggtgatagtgagcaggctgttgggacaattcccaagaggcagggttataaagagggggaacaatgtgggtaggagaagggtctgggacaactgcctctgcttgagggggaaggaggttagggatattggacgggggaaggtggtggaggaagttccatgtgttggtgagctgtctaggaacagggaccttatctttctcagaggagttaatttctgacttgcttttcaggattgattcctgagtccaaatgaaacaacaatattttatcatttgctgctttttcttgtatttagtcctttcactctcttttcaatattttagcataagccctaggggactatcaggaggaatgttattgttgctagctttatcctttttctcccctgcattacttgaggtatttcccatcttgaaaagggattggggtgaggctcaatttcccctactagaaatttcttcccagttacgagaggtttgtataaggctcaacctctcctactggagatttctcacctttcctttccttcccttcccttcccttcccttaccttaccttaccttacctttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccctaataaaagagtttcagcacagatctctaaagttctggagcaaggccatgcagcagagagatattcgacttttgaaaagcagctgtttggccccaataaaaaccaagagcctagcaatgggacatcaagggtctatgcaaccagagatacccattgtaagccaggtattgtcagagtctaccaagtcgtaagattaggcaggtttaagccaggcatggtggctcacacctgtaatcccggcactttgggaggaagctgagggcagagaattacttgagcccaggaggcaacatggcaaaaccccatctctaaaaaataaagaaaaaaaaattagctgggtgtggtggtgtttgcctgtagtcccagcaacctgggaggctgaagtagaaggattgcttgagcctagggaggttgaggctgcagtgagctgtgattgtgccactgcactccagcctgggtgacagactgagaatctctctcaaaaaaaaaaaaagcagacttatcagcaatccatcatataataatagaacaggaatggtaaattcaggatcaggactaagcaggtcaatagggtgcatgtaagtcaacaaaaggtggctcagactcctatgacacctacctcagctatcggctataccaacccttctgtcttagctcagacctacagccttagtaggtagttctctgtaaccaactgatggaggggaaaatagcccttactcacagatggattagctttagacattgatactagttaaaaaagaaaaaaaaaaaaaagagattgttcctgtaacatagctccatttagggggtagccctaaacaactttgaagggaaattcccccagtgggctaagctgtaagcagtatacttgttcattcattttgtatggaggacaaaacaattccagatagagatttacatacacttgtgagcaatggcaaatagtcgagtggtacctgttcagccctcacttatgtgcaatctggaagtgcaagcagttgaccaatggagacagaactaggaaacaaatacctcctcattctatatggctctttagaagcccccagtgggattaaacctcagtaacccacagcaatggggattgagacaaggctgaggtgaggaaaaagagcaaggcacttgtctctggtgcaaatttaaggaggcaccaagaaattcagtaaccaagattaattatattttaatgcaatattttttaaaatagaaattaatgcaaatacccatgatgaacgcaatatcaaaattttcaataaagacaggctcagtattgctaattttccatttattcttaggctccactagggctccacacaacactgttactgatcttggtcatcgccaataaccatctcaatttcacagtctatgttggctttacctccctctctgttcactctcctccctagtccctcacttctgttttatggtatcattactcagaataaacgaccttatatacgttcttgtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatatccagaattagtattgctggatcatatggtgattctatttttaatttttttagggaccaccacattattttccatagtggctgcaccattttacactcccactaggaatgaacaagggtttcaatttctctacatcctcactaacacttgttattttctgtgtttaaaaacaacaacaacacttttttagaggtggggtcttgccctgtcacccaggctggagtgcagagatatggtcatagctcactgcaacctcaaactcttgggctcaagtgatcctcctgccccagcctcctgagaagctggaactacagtcacatgccctcatgcctggctaattttttatttattttttgtagagatggggtcttactatgttgcccagtgctgtcttgaactcctgccccctagcaatcctcctgcctcggcctcccaaagtggatttctgggtgttttttttttctttttgtagtagctatttttaagggtacaaagtggtacctccttatgattttcatttgcatttccctagtgattagtgatgttgagcctcttttcatcgcttgtacccccaatttatagacaaggaaactgaggctttcatcagtgatgtaacctgcctggagtcagccaggtggttggcagtggagtcaaaactggccctctactgagtctgactccagaactctgtgtgctgccgcccctctgggggagagccatccatccatcctgcttaccctggtacttgcttccttccctcctcctcccaaccaccagagcccagttttttgttgttgttgttgtttgtttgtttgttttgagacacagtctggctctgtcacccaggctggagtgctgtggtgtgatctcagctcactgcaacctccgcctcccaggttgaagtgattctcctgccttagcctcccgagtagctgggactacaggggtgcaccaccactcccagctaatttttgtatttttagtagagacggggtttcaccatgttggccaggctggtctcaaactcctgacctcaagtaatctgcccgcctcagcctctcaaagtactgggattacaggcgtgagccactgtgcccagcccctagttgctttttattttacttccaccactcaaaaaggaagccaggaagggaaaagctgccaaaaaaagcaaatcctggtgcatgtgtgtgaatgtgtgatgatgtacatccttagaggtccctgtgaacagcgtacaacatgagtagctatggacttggaggccagcagctactcacccctcacgccctacagtgaacaaaaccagcgagcaatggaaaagcagacaggtcagcccagctgccagggaaggctgccactcatgggtccagcctccataacaggcactgataacactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaaagggtaagctaagataataattcctgtaactgtggtgttgttaatagcaaatgttttttaatgccttgtgtgtgccaagttctctgcggggtgctggagagacacaaataaataagacagacacagcctctgcccttatggatgatacctggacccatccctgagtactcaatacgtacttatgcagagaagaagaatgcatgaaataagcagtctgattattcccagcagcacagacacctgatgggtgtgcagtaaatacgtgaaggccactagggcaggggtgatgtgtgacctggccaccacacatccccaccctgaagagggcttccagaccctgtgactgccttatgacttggtattccagcatgatagggtctcagcaatacagcaatctccaaggaccaaggccattacaggggaaaaggaaatctgagggcttccttaaagaactttcgggagagctggagaagccatagaatctgcagcttgtctgacctgctgcctagaactcagggtaccttatgagtgggtttacagcatggcccctaagaagggccacccccaaactccaggtacagaacctgacctggcatctcccctgtgggaaggcacagtcagaagtaagcctctgatgttctcttaagtcagggatgtcaacatgagctcatgtgagggaatgactggcctggacccggatcctgcatcattccaatctgtccagatgctgcccaatgaaatggggaagtttatggaccagattctaaaaaattcatccagagtccccaccccacctccacctccaaacttgtgatagaagcctttggagatggattacactgcccagagactcaggggccaggaaggtcatattcaggaggaccacttcacattcccccggacagaagtaaacgggtaatgaaggaatttcaggatggaggcaaggagtgtaggcagtctttgggatgtgaaatcgggggaaacaagcaatgtatgaagaggagtttcaggaattcactttgggatacattgggtggaagcttccacagacccttgaggatcccttccccccagaaaaggtctgcactgtttacattcactaggactcttggagcccagctgacaggcctctgaccacaagccatgctgtacaccaaaccctcaggacagccagtgataagtgatggctgccccttactctctaccccatttagtagggtctaagtcctggggagcttctggcctacagacctcagagagacaatgcagtgaccagctctcctgctggcccttccacctttcttcacttgggatccaagtctgcaaggggctgagcagaaacctcctccaccacaaagtgatggagaacagcccaatggctggtgctctaatggattcagacaccgcacccccccacacacacacaccccaaatacactcccatataaacaccgctaccacacaccacttgtttctctcccagctgaacagatagcagcatcttgcctcctacagaggcacccacattctactctgaagggcccctcccttccttggactgccctaggtttgtgcttctcaagcagttctcctctttgcgggttgtcagagacccagtggacacatttcatcccaccacctgtgaggagcccaagagcagggtccttatcacagcttgactaaaaggacacataaggttaaggatttgggctaaatgagagacctccacagagtctggaaaagtaaaaggtgtctccctgatgtagccagatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacaatcttctagaagagatcacataacactgttacaaaggatctggagaaagggaccctggcttcatcactgtggctctccagtcatgctttacatttggcagtgactatctccattcaactcaattccctaaccctaaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggaacagaaagtttaataggcaagaaagaagaaaggctccctgcggtacagaaaaaggggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcaggaggctgaggcaggagattcacttgaacctgggaggcagaggctgcagtgagctgagatcacaccactgcactccagcctgggtgacagagcgagattccgtctccaaaaaaaagataaaaagaaaagaaaaagaaatgtttctggagttgtttctattaaaagggaaagccttactgaggcctccttaccctctctatctgcctagtataatttctgaataactcctctattaaaagtaccactgaggtgcttaatatgacatttctgatatttcccaatgctcctccacaaattcaatttggaaaggtaatctgttccaggagggcaaaccaaagaaaaagtcctaggctcctgagtcaaggcttgtttctttcctttgtacaagctgactactttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcctaactactaaataaaagctaaactactcacttcctcctagattcagagagagctccaacattttctaaaatttggtatcttgttgttgaggtaggcactttttggcaataatgaatagacatttaattagccaatcaaaaaaacttattaggtacagtaagttcctcttcaaaggtttaacctgttcaacttcctcgttctttgttcctaagaacaatttccctgtaccttctcacccctatttacctgcttagttatctgctcagttacctgccttgtaaacaactcttcccgtcagtcccaacctgtaactcacattccctctcccttccttattagggagaatattcgcgatagcaaatcaagtctgcttagattgtgtagtccgactccagcccatgtggaaatgacagagaggtagggactgcgttagggatataaactcctgctctatcctgctcggtgtgctcttgcattcgtgactaacgcaaacagcagtcttttgcagaagtaagttgtcttgctgagaaaactttttttcctgagtgctggttcttccttgcagcactgatcatttgtttcttttttctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtaaggactatttgagaaaaacagggcatgtaaagcccccacaggaggctgggcataaggtggtgctcactacagggactggagggagctgttaccaacacccattagggtagggcctggcacaccctggatgcttggccaaggccagccatcattatagcttgtggggaaggagccccggatgatgttcttgggactcctggaggcttcatgggctgagattgcaagcccccagccctgccgggccgatagcctcctccctgtctgtgtgaggctgtccctccctaccaggtcccgcgtaggggaggtcctggaagcaagggaggggctggatcttgagccccactggtgaagacactcccacatatcttcagtccctgtagacctgccccagaggtacctgctaggcaagctgtggcctgtgcctccccagcgctgtaaatctccccagatcccacccaaacccaacctcagccatcctggctccttgggcctgagctgctgccgcgtgactttgggggacaaaggaggctcttcctggcaaaccttctcccagactgcctgcctggggcctgcatccccagtcagctccaaacaaggctgttgctgctgctgctgccgcagccgcagctgtgacgtgtggaggcctttcctcggagggcaggcagccgcgtgggcaacagatgtctcagctccctgccgcctgcagccgtcagccgccgccactgagcctgtcagcggcctcacgcccagggtgcctggccagcccgcttagtgtccccaccagccccctcagcggacacacagcatgacacacacaagcagacacaggcttgcgtacacacacacacacacacacacacacagcaggaatcctataggaaagaggagatgaaaggctctgggatgtgttgaaggcccacctcactcggccccagggacctggcagtgagggcagatgtgggaagcctcctaggacagctgggcctgcctgtcaccctggcccccagaaacgggattccatgattccacgctccacctggtgcccaccccctcccaagaactggacagaagtctcttaaagcccagccggcttggcccagcccccatggcaagaggtggcagtagggtgggggaaggtgcttctctgtgcctctgacacaggcccccaaagacaagatcagcctgtgtgggagcaagggatggccgtcagatggtttcaggttatctcctctgctccttccagactgagagccgccaagggcagggcctgggttctctcctcttctgtcccttaggctggggacccccaagggcagggtctgagtcctctcttttggccctccagacacgaggatgtcgaggctgggccaggatcctgtctcccctagacaggcaccccctcgaacagggcctgagtcacctcctccactcctctatcctcagactagccacgctccagggctgtgccggctccttttccttctctgtgggcaaggcagggccctgggaaacttgaggaacgggcctgaggctgtcctggcccccggctttgtgtcatcttgtggggaggggtctcacaacctcacagttaagtctccctttccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtctcctgttcaggagactcaacatctgattgttttccacctcagcctggagctgtcttcccacactctctagctccttccttaggtggttggtctcatcttgtagctgctctaccttagatggccctgctgggggctctggggccaggggttcagctgagaaagcaagcagagaataagggcctctggattctcaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtaagcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattgacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaagcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaagacggaacgactgtggtgatcgagtagccaaaagttcacggaatgcactgtcacaattgtgattccgccatagcgccgtgcatccatccaacacttgtttaatacctatatttaatacctaataccttagagtgtcctaggctgtggacacacaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgctccgcgtgtactcacgggaggactcgcagacgttactgccttcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcgggatgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaagcaaaaaccctcaaattttccttctttcttcttttttttttttttaaatcaagaaagggggtagataggtttgttttgttttggaaatagtttttatagcagagtgataccgtcacatttaatgatcctactgtgaattcaagaattcacgatgaaagttggattgagcggtattttggtgttcattctttgctgatactcattaatgaagttagttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacttcaaaaggactcaaagccatatactagttcccaataggcctgcacaagttattagaacaagctgctttgcattcttgtgtgatcagaaccagtaactagatggcaatcaggtctgttactgaagatggaaaaactatacttaagtttgtataacaatctttcataacatggcttcacagaaaagaagtataaaaaggattccttggttgaaaaagagtgctcttttcccttcattatttaagattagggcaaatttataaaacaggaaaaaaatagcacaaatcccttggcaaacagagtaaaacatctactctgttttgctttttttcacttcttacactctctttcataggaagtcaatttacagacttccatcaagcccttagagacctttttgtactatccatgacaagctcttgatgttatctctgcacttttgacaaattcttagcagttaacttacaaggcagttaagatttttgttcaagcacaatatagctagaataggctcatacattcaataaaacaaatatttaccaagcatttattgagtggaagataaaaagcacaaagcataattatgaaatattttcccctgccaccataaaaaaattaaacaggcttacagaatacagtgtaagaaaacatgaccaaagcaaaaatagtaaggactaaagaagggaggaaggggaaatatcaacatggactgaatatgacccaaaagagccttgatggatggtcagacatgtaaaggcaaattggttagggttaaggggtggaggtcagggcacgttctatagggaaacggcagctgatacagaagcctgaaaggaaaagcgggcagggcacctggacaggactcttcaggaacgagcacgcacgtgcgtgaaaaacaacttagtgaggtaccgtccacccaaacattagagaaaccgcgtaaaaatgcttcttggtaagcatgaagaaggcagggctcggcctgtagaagaactcaataaacatttgaactgtctaaagagtaaaagttaatgaataggccaaactcactcctttctttgttttaagagctacaactttagagaataacaaatcacaaacccagtagacaggtcctggcatttgaaatccaaccccatttttcccttaatctttcccctctgagcaaatggtatcgacatgaacaagccatgttgatttgatcaagacactcatccatggttaaaagagtctttactttcaagagatacaaacagaaatatttacatgggctaatttactgggcaacaagagagaaactccgtctcaaaaaaaaaaaaggaaataaaagcatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagattacaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacactttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcaataagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggtgggtggatcacgaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatctgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaaggggggacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgggcctgcactatgttaaaaccactggcaaagagggtacaaagttaaataaggtctatcacagccctcaaggagttaaaggactagaggaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaactgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaacgaacttcattaatgagtatcagcaaagaatgaacaccaaaataccgctcaatccaactttcatcgtgaattcttgaattcacagtaggatcattaaatgtgacggtatcactctgctataaaaactatttctaaaacaaaacaaacctatctaccccctttcttgatttaaaaaaaaaaaaaaaaaaagaaggaaaatttgagggtttttgattttttcaacttcacataccggtttgcctttgcaaaaaaaaaaaaaaaaaatgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcatcccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgttccggctccgcgacagctctgcacgtagccccagccaccccgcgcaccggctacaagccgcccgggggtggccggggcacgcaagaaggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaaggatcacagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgtcccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgagtagtacaacacaattaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaatgaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatcggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtctgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagggagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggctggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgcggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggatgaccgcgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaaggctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcggacacacgcacacgccagattgtgcacacacatgctgtgaggccccacggcccgcatgcacactctaacacatgcccacaaacaacacgcatacgtcgccctctccgccacctcccggtgcccaacaccctcaccagccggcacgtgccacatggatctggggcgtgcagccactcggcacactgaagcacatgcgtgggcagagtcacaacacagatgctcacccgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccaggctgccttgaagaagctctcccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcggctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaacgtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagcaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacacaccccccccccccccggcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcatgctgctgtgcctgctctgccaactcctccatcagtgtgttctggttcccacatgagtacatattggccagcggctccgagatgatgaactccggggtctgagagtgggcaaacagggaagaaggtgggacctggtgcctgtgccgccctgggtgccttggtggggccttctgggactgtgcgctggacttggagccccttggagtatgggttttcacatgggcttctataccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgttgagctctgcaggtagtgatgccacatccctacagagatgcaccataccaggactccaagatcatggttcttagtgttctgcctctgcagttcccatactctgccatcacctattctagcatctgggagcaccataccagagccatttcttgtgtcaatgtcatggtgacagaactatgtccttcatctctccttgagatattcctccaccacaggtcaggcagcttttttttttttttttttttcccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttctcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtggctccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgatgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacacgaactgaggagtcctcagctacctggagccacgtgacagtctccttcttggggagctggttgcagaggcctctcatcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtagacaatgcctatggccattatgaagctttctccaccctggctcccaaggcttggctgtccgtggagctagctgagccatgcgtgcctgagccagggctacctcctgtctttgccaatttcatccagctgctatcagcgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcaccctcctggacgtggtgaactgcaaggcccgcttcatccacgatggccctgaggacacctctgaccagctggtgctggaggtgtcagtgatggcttggttgcccatgccctcatgcctgcggaggggccaaacagacctcctgcccatccaggtcaaccctgtcaatgacccaccccacatcatcttcccacatggcagccttatggtgatcctggaacacacacagaagcctctggggcctgaggttctccaggcctatgacctggactctgcctgtgagggcctcaccttccagctccttggcaccccctctggcctccccgtggagcaccgagaccagcctggggagccggtgactgagttctcctgctgggagttggaggccggcagcctagtctatgtccactgtggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccgtgtcaccggaggcctgccgttcagggagctgcagaagcagggggctggtggggtggaggatgctgagtggtgggtcacacaggcgttccaccagcaggatgtggagcagggccacgtgaggtacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaactttcaactacagggcacgatgctgtcagacggtcagggcttcacccaggatgacgtacaggctgcagaggtgacctatggggccatggcacatgcctcagtggcagtggaggacaccttctgtttccatgtcacagctccaccatatttctccccactctgtaccttctccatccatattggcggtgacccagacatgcctgtcctcgtggtgcccgagggtggtgggtgtgtcctctctgctgaccagctcttcatcaagagtctcaacagtgccaggtacctctatgaggtcatggagcagccccgccatgggaggttgacttggcgtgggacacaggacaagatcactatggtgacatccttcaccaatggagacctgatgcatggccagctggtctagcagcatgatgactccgagatcacagaagatgatatcccatttcctgctgccatcaggaccagagcagtggtgacgtggcctgggaggaggtatggggtgtcttctgagtggccatccagcctgtgaatgaccacgcccctatgcagaccatcagctgcgtcttccacgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttttctatggccacaatggcagcctcagctcccgcaacaccctggccttctcaatggatgtgggaccagtgcacacagatgccaccctacaagtgaccattgccctagagggcccagtagccccactgaagctggcccagcacaaggagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgtgtgtgtgcacgtgcctcagatgtgctcccatatatgttgtgttcccaagagtttctggggagcttgctgtacacccatcctcctgggagtggtgtgtgcctctagagctggtgtccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtaccccgctctcttctcagagcccagaccaggaccaggagggtctgtcaagggcttctgctcacccaggaaccccacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccacgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcgtcagcatctgatgaactcatatgtctgtgtcactgagtctggggacatgtgattatgcacctccctgagggagtgcatctcaagctgttgaccgacaccccgtaaccatgtgtggggtgggtattaacatgtgaccagctggggcaacccagtgaaaccccatctctacacaaaacatttaaaaattagccaggcatggtggcacatgactgtggtccccagctacttgggaggctgagcccttgagcctaggacgttgaggctgcagggagctgtgatcacaccacagcactccagcctgggtgacagagtgagaccctgtctcaaaaaaacaaaaaatgtgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctgcttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtactgctggggcctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccaccccccatgtctgctttgagaaagaggccaatgtcccctacttcccggcacagatctcccccactctgagcctcagtttcctcctctgcaaaatgaggacactactgtgtgcctcacgcagttgttggaaggagagatgtgagattgtgctgaaatagaacacaggtgggaggttttgttattggacatttgcaagtacggtaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtggaggcctcagcttggcttcccaaactcctgccccttgtccacagcagagcagggcccccatttggcaaaggtggaagttgaggcccagagatgggatggaacttctccatgattgcaaaagtagttctggtggaacagaaagggcatggctttactaagcccacgtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggacgccacagaagagtgggacacagcaccctggaaccacaggctgggatggctgtgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagagtggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccaggcacacatggagggtctgaaaggagactgctgccccaccagtgagctagattaaggagcactgttggtcagcgctgggggtttctgggggtgagaacttggtgacggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagatgtgggagggggccaccgtgcccatccctacagaggctctgaggagcatggatggttactctgggcccaaggacctggtgtacaccattaagcagcccagcaatgggtgggtagtgcagtgggcggtgccgggcactgaggtgcgcagcttcaagcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacggaggcatccactttggcctctctgacggtgaacatacttcctccagacacttagcttctgagtgacggcccagaagcaagtgcttcactcgctggagggcagccggacactgactgcccaggtgggtgtgctgattgtgggcgttcctgggtgcggggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggagtcatcaggctggcagggcaagttcatgttcccagaaggagggagaagaatgcaggaagtcggggatacagggccccagagcagggctggggtcttggggtgtggcttcccgaaggaagctagagctggacccaagggtctggagagggagaaccatgtaggggcactagtggcaccccagcagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaactgtgccacgggggccagcccactcatggtttaaatgaacacctctccccaaaggcagaatgggagttgttccatagcagggcagggcagggcagggcagactcttgtgggccgccctgggcaggcagcacacctgatgctcccatcaggaggctgcgtgagcatctggacccagcacatgatcacagtgagttctcggcagggagcggtcttgtggggcgcagagctgactctgtcactcaggagccacggcacacagcactgccccaagtacctccagaggggatccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggctggtgtctacagctgctgcgtaccctcagttgctgggagcctttgtcaagaatgcccaggaatgaggagggcacaggacccagaccatcagcaaccctcttgcactctatagtcccatgttactcagagcttccccatgctccagcaagatgaaggactagattgaatgggcaccaggctggcagtgccacccaggaaagctgggaagaggctacatgggctacctggcccactcagggaggagggcaggactgggtattgtcttgacagcaaccctgtcccacaacactgaactgggcagggaaggggtcaggtgtcctcatttttcagataagaaaactgaagctcccagagggcaggtaaatgtattcagagcacatggcgagtaagaggcaaatcttctgccagcaagtccaggatttttttcaccagaggacattgcttggtccccagagctcaggaccctgtgttttgtctcactcccacccacagagctcctgtatccaggcatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataagtcttaagtcccctcccagatctgtgacatttgacaggtgtcttttcctctggacctcggtgtccccatctgagtgagaaaaggcagtggggaggtggatcttccagtcgaagcggtatagaagcccatgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcatgacgagatgctgcacatgcaccacgcgctgaaggaggcgctcagcatcatcggtgacatcaacaggaccactgtcaccatgcccatgcccccgcccgtggacgacacctggttgtcagagcatccctgacgaacacaggtaccaaagactgccccccacggccccaaaatcccccacccgggatgcccagaggagtgccctgggggcaagtggcacaccccctcaccggggtggctcccacctggagtgacggggggagcttgacaaggagcactggctgccggggggggggggggtgtgtggagctgggatgttctcgctgctgggggcggggcttaagctctggcaaccgccttggggtgtggccggcactgcgctggggcggggtcgcccatctctcccctccctgtgcctcccaggtcgcccaagtccagcgtcaggatgcccaggccctgccatgtccctagcccggcctgggtggcagggcccaactcctgggcggcaggacccagctcctgggcttcctcctgccgggtccccccttggggaaacgtgccccataccctccaggccaaaagcttcccctgatccctttgggccctacccccctggtgctctcgggccccagccggggtcccccaggtaaataagggctgaatgccgctgaaaaagcccctggacacgcgtggccaggaaggaaatgggactggattccaaaaaatcacatctggccgccagaactggccgtctccatccaaggcactgggaccatggggtgcccgaaccacctgtggcccaaggctgggcaaaacctgccccccagggatcactgaatcctggaagtggtccttttttaagaaggggctgtggggctcatcccacctggcaccttctgttcagcacatggatgacacttccctctaatttcactcctggcggctgaccacacattgcatttctcttcctttcttctcgctgtcctccatccttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaccaccgggggaaatggatgaaggctatacaggccctctctctattatttttgacaagagtgtgagaatccacaattatttcaaaataaaaagacctccctaagtgcggacagaatccagccttgggccaaaggtgcgcaaactctcctcaaaatggggctccctgacagcacggccccctcctccaccagggcttcttccctagggctgggaagcacctccctgagatgcaggctcccaccctcctgcagctgcagtacctgatgagcaggatggcagtgtcatgctgcagggggtgggcgtctcccttcatgttgatgcttttctgccacttgcagaagctcttcagggtgttgtctgcatggtgcatgatctttaggtcctcctgggggcagagagagtgactgctcatgcctcccctgagttccaagaaggtcaggcccaattctcccccatacaaaggcaggagacagaggcccagcagggcagtgggaggcccgcaggcaccagtccagcttccggcctgaccatccctcctgtaggaacctcctgcaggagacctgggacctgagagagggtcagtcaggaaccagggagtggcaggggacacagtccagtccaaggaggccttcactgtgcccttccatacagagcagcacaggtcatggggcaggagggctctggcagccgaagccattgccaggcagcgtgggaccacatgaccgctcacctcctcatcttccagaaggaccaggagcacaatggtcatgtggatggggttcccaatgctggggtcgtgaaacaggccagccacctgcccaagagatgagggggtcaggctgtcaccaggatgaaggatacaagcagccaatgcccaccccaagccacccacccacccagggcaatgcacacctgtgctcacacacagggacgctcacacgggtgcacacaggctgcacagcggataggcaatgcacatgcaccaatgcatgagtgtccccacacctcacacgcactgccccaatgtggcagcagcagaacctacagaggacaagaggcctccgacgccccttcccagaccacaaatctttcctagaccacagacaggtaagcttggtatcagtccccagcaaagtggctccagaggaccagaagcccctgagggtctgctctgcctgcctgaggactgacccaagctatattctgagtcagggctaggggcagcttagtgccaccacaaaggccttccctcagcatatataacctcactgtctcccaggagctatgggggtaatacaggcattgggagatgttggagggaggcagggtcttaattggctgatcaactcaaccaagtaacattggttaatggcccaaggtcaatgtggggtgtttcaactggataaatgatatccagggaagcccagccctgttctgctgcaggtctggagagcatgccagaggtgtgcagtgtttgtgaaggtaagatctggaggttacagataaccacaggctcctggtgagctgaaagtgtgacaagagcccctcgaaaagggcttgtggcctcagagagtaagaacagaattgggggtgaaaatggggtgaaactggctgagcacggtggctcatacctgtaatctcggcactttgggaggctgaggtgggcaaatcacgaggtcaggagctcgagaccagcctggttaacatggagaaatcccatctctactaaaaatacaaaaaaattagctgagtgtggtggcatgcgcctgtagtcccagctgctcaggaggctgaggcaggaaaatcgcttgaaccagaaggcggaggttgcagtgagctgagatcacgccactgcactccgacctgggggacagagtgagactccatctcaaaaaaaaaaaaaaaaaaaaagaaaatagggtgaaaagggacctgtcttgctatccttgggacaaacccacccaagctctaggactcagatctgagtctagcacagggagaacacggataaattggggtctgtaggtggcgttggtaaagaaagatgaggctgtcctgaaggtggctgtgggtcagatactgcagcagccaaaaaaatagccacagccaaccttgatcgagcctaacatgtacagtccctgtgctgggggcttagcatgcattatctcatttaatcttacttctgaggtaggcacaattatcctcattttacaaatgaagtaactgaagctcaaagagagggtgaagctgggctcagaacccaggtttcactgcttcaaagcccctgcttatttcctaaatttggggaatgctgcctgcctattctgttggggattctcaatgaatatttactttgagggctctgagaagtcctgtagtaacgaagtctgttttacctttttttttttttttttttttcgagacagtgtctcactttgtcatccatatggagtgcagttgcatgatctcagctcactgcagccgctgcagcctcgacctcctgggctcaagcaatcctcccacctcagcccctcaagtagctgggactacaggtgtgcaccaccatgcctggcccgttttactttttttaaccctgtgtggccaaacttattcaacagcagcatctttttttttcacagtgcactactggcattctttggaacacactccctgaaatattccttgggaaatgctacaatgagacagagtccccacatgcagaatcatgctcttccacatccatcaccttatcccaggtagagcgatggctctcaacaagtcagtcttaaataaacatctgatcctgagggaacatctgttccccatccttctggcccatcctggcccagggcacacgtctccagggcttctcctcagcgagttctctggggcactgggaaccacacagggatcagaggcgaggggcctgaattcccctcctggctctgccccaaacctgtgctgtgtggctctgcctgaccactttctttctttgatcttgagattccctgactaaaaataggaataagttgatctgcctcatggggggacctcaaagggtaaatgaaatggtggatataaacgcagtaaagtactgtgtccatgggaggggaactcctgggcttgacaaagctggctactgggcccctatctccccgtgtcacttcctcccaccctgggggcttagtgcatctcaacactgacccctgaccccaccctctaaaccccagcctggggaggctggccaagacccagcccagcttgccctactgagcctgctcccctgacccaggctgctccagatcagaagaggaagcacatctatgaagctggggaaaatgaggccaagaagcatgcctctgtggatatgtgctccagcaaatggagtaccagagctgtgggcagcctgagattggcatgccagccaagcattccccaaatcccagcaacccttagcaggcagctcttcacctggactggccggcactactgctgctctgcagaggaggcactgggtaccacactccaggtcccaataatagaggttagttattctagggtgggagcagggtggcatggggagggaggttcctggctaatggccctgttggagctgggcatggctcacctggtctggacactggagggagaatggctggcagagccaggtgccataggcttggtggggagggagcaagagggaggttgagccccaaggtgggagaagtaggtgagatggagagagggaggtcagtctaggggactgactgggacaggcctgaaaggcagaggacacagtcttgtggcacaattaagggcacacgctatagtgatgtatccgtctgtctgtctgtatcctctggtctaagggacaccgagcatgggcatgttacgaggggcttctagaaaggccccttcatgtccccaggcctagcacctgcctgagaactgggagtagaagagcataccttgcaccccacaggtacttggagcactggaatcaccccgctgtgccagcctctccggggccggatgcttgtacaccacatggggctgggcatggctgggccaggctggggcaccgtccaggggctgaatgaagtagtccttgttggagagcaggaacacacctttctagggaagaagcaccagggtcacacagggagggctggccctcagctgctcttcctgcacgtcccagaggcccatcctgctcagctgagcccccactgcccacatcatctgtgactgcccacagacaccctgcactttccgcctgctgggcctttgctcactctgtagcctccatctggaaagcccttctctgccatttcacacacagccaaaccttcaaagcggagctcagaagcctccgcccctggggatgctgccccacacacccaccctattaggagaggaaaacgggtctgcacccaaatctgacaaaatggtgtcttccaaagtcccagacagctgtcctgagcagggcagcttgtgcccaggcctccaggctattctgcgtcttctctgcaggccagccatttccagcactgtgctccctcccagctggccagggcttctgaccttccctctatctccctaaggcaatgaatcactccaaaagcatccacacccacacccgagtggcggagatgcccacggccaccaggacaccctgttctctgggcccagggctgcccagagaagggaagctggcaggagtgtcttggacatgtccgccaacattcagagtccagggaggggaggggccccaggaagcatctatgatgcccactacctcctgaggaagctcagggctccaacaggaaagaaggttttacatccctcggacttcccctcataggcaccaattctgccccttgagtcacacaggaccagggggcctggagggagggctggagagtgcatcagctcttgggtctggagacctgggtatgaatgcgaagtccccccctcccgcccaccactcactgaatgactaggtgagcctgggcaagttcccctctgagcctgtttcctcatctgtgaaatgggaatgatgccccatgtgcacagctgtggcacaggctcaacaagatcaattgtacattaagggacaggcacaggctccataaatgggaatactgtgcagggcagatgggccttcaaaggtccagacgttgtgcagcttgcgttgtgggctgccctgtcattaggccctgtgcggccacagcccatggtttttgcctgagcaatctaagctgagggcctcctgggaacagtggacgctgagagtgtgcacacatcccctactcctcccaaacccccaccctccagagctgggagagtggggctggtcacctgaacacgaacagaaaggggccctactctgcctggagtggaagctgctctaatcagcacccaatcagggagcaattagggctgcagtagccagcaccacccttcagccagtcgaaaccaggaagctgaggcctgcttttcccggagctctgatccgagcagaggggctgaaaggggttcctcaccacaccctgcagaatggctacagggtgaggggtggctttcctggagaaaagcagcctaaagggacctgtgaaggaacagtcataactgatgccccaaggaagagaagtcaactgctttttcagttacttagtccagtcaaacagaggttctcaaaatgggatctctggacctgcatcttcaatattacctgagacgttttcagaaatccaagtgtttgggcgccattccagacctaccctgcaaaaattctgtttaaacagggcctgcaggtgatttgagctcatattaaacttttcttttcttttctctttctttctttcttttttttttttttttttagtgcctggggtctcgctgtgtctccagctaagcgccatgatcacaccctacgtcctacatcctttaactcctgggctcaagtgatcctttcgcctcagcctcccaaatagctgggactacaggtgcaccaccacccggctttcacattaaactttgagaactgttgtcctagagatgaacgaggcctgcgttgtcactcccactttacaggcgtgaataccgaggctggcagagaaaaagtgcactgggcaaagccaccagacaagtgcgtggcaaggctagagccaatctccacatcccaccacccgagactgccccaagtatacatgtcccagctcactcaccaggccgtcgcaggcgctgatggccgccaggccaccctcgagctcggagtcctgcacctcgccaagcaggtggcaggcgggggtgtgggcccggatgtgcgcgcgacccagggcgccgcgccgcggcatctcgctcacaaagccgggcgccagcaggtgctgattggcggtcaggttgaagcgcagctcgcgcctgcggtattgcagcgggtagaaggcgggcgcgtctcggcgcacagatacatcccgcttgcgcagtgcgcggggccgcagctcacaggacaggaaggaccccccagcgtccacgcgaacctggtgcacgatatccggtgccgcccggccctcggttacacttcctgcagggagggaaccacaaaggccttaggcccagggcagaccggggtccttgctggtggccagggaccagaggggagcggccaagagggggctgctggagtcagagtatctggattcaaatcctcgctgggctatctactaactctgctatttcatctttccgtgcctcagtttctccatctggattgttgcagtaactccttttgttgttgttgtttgtattttgggtttttggttggttgttttgagatagtctcgctctgtcgcccaggctagagtgcgtggcgcgatctcggcccactggaacctccgcctcctgggtttgagcgattctcccacctcaggagtagctgggactagaagcacgcaccaccacgcccagctaatttttgtatttttagtggacacaggatttcaccatgttagccaggctggtctcagattcctgagctcaggggatatgctggcctcagcctcccaaagtgctggaattacaggcgtgagccactgctgcccggcctggattgctgcggtaacttcttaacaggtctctctgtttccactattgcctaccccaggtgcccctcccctcatgttttcaatatagcagccagagtcattcaaaaccagcctgatcatggtccttctctgctcaaaatcctgcaatggtgcccatctcactcgagcaaaagacaaagttctggcctgtatgagacgctaggcaaggtgacctgtccaatctcatttccagctacaccttcttagttccctccactccgcccactggcctccttgcagttcctccacaggccagacatgctgctgcttcaggattttgcattgctgttccctacacctgcaacactcttccctctgttttccacgtggctaaaccactcacttttgagttcttgctcaaatgtctccttctcaatgaggcctcctataatgactttattttaaaattgcaactccctggctctccgtatccctcttccttgctttatttttccccatagcacttctgacataccatatcacttagcattttcattattttttctatttatttgttttctccctcccctcccaatgtagtctaggaaggcaaaaatctttatattctttgcccccagcttttttggaaacagggtcttggtctgtcgcccagacaggagtgcaggtgtgcaatcataggtctctgcagcctccaactcctgagctcaagccatcctcccatctcagcctcccaagtagggagggactgggactacaggtgggtgccaccacacttggctaatatgtttttatttttagtttttttaaaatagagatggggtctcactatgttgcccaggctggtctcaaacaaactcctgggctcaagtgatccttctacctcggcctcccaaagtgctgggattacaggtgtgagccactgcagctggtcctggataatttttttgtgtgtgtgtggagatgggagtcttgctatgttgcccaggctggtcttgaactcctggcctcaagcaatcctcccacctcagcctcctaaagtgctgggattacatgtgtgagccacgacacttggccctttatattctttgttgaagatttaagtgtcagaggaagtgtccagaacttagtccttttttggtatttgttgaatgactctgtagaatgtggataaccacagcacttacactcttgatgctgctgtgaggattaaaccaggtgagctactccacatttagcagtgcctgaaccactggttgaatatgatggcaattatgattgttatgattattattagcctgatggatttaaaaatgtgctctcaggtgcgtgagcattctgcaagtgtctccaggcctcctggaatggggagacagagaaagaccaccccagtggggctgcctggcccctaactgccacttcaacagagtggctctggtttctttcttttacatggaagaattcatttaaagaaaggttccagggatggaaaaaattggcagacctctgctcaggcccttgcagtttaaaaacccctctctgttgctctgtcctctaggatttcccaataaggcctggattcttatccttttttgccacaaactccttctcagaacaatattttgaaatgcagaaaataaaatacataggagtggttgggcccggtggctcacgcctgtaatcttagcactttgggaggccgaggcaggcaaatcacttgaggtcaggagtttgagaccagcttggccaacatggtgaaaccctgtctctactaaaaacacaaaaattagccaggcgtggtggcacatgcctgtaatcccagctactcaggagaccgaggcaggagaatcgcttgaacctgggaggtggaggttgtagtgagccgagatcgcatcactgcactccagcctgggtgacagagggagaccctgccataaaaaataaataaaataaataaaataaatgcacaggagtaccaaggaaattgattatattgaaatacagttatcaaaataatttaagaccaggcaaggttgttcatacttgtaatcccagaactttgggagaacaaggggggaggatcacttgagcctaggagttcaagaccaactgggcaacataatgggaccttgtcgctacacagacacacacacacacacacacacacacatacaaaattagccaggcatgatggtgcacacctgtagtcccaactacttggaatgttgagatgggaggctctcttgagcccaggaggtcgaggctgcagtgagccatgatgatgccactgcactccagcctaggtgatagagtgagacattatctcaaaaacaaaacataacaaaacaaaaaataatttaaaaagtagggtgtggaattatactttaaacaagattttctggcaaattaaacaactatggttttttttttttttttttttgagacagagtctctctctgtcacccaggctggagtacagtagctcaatcttggctcaccgcaacccctgcctcccaggttcaagcaattcttgtcccttagcctcgcaagtagctgggattacaggcacgtaccaccacacccagcaagtttttgtatttttagtagagatggggttttgccatgttggaaaggctggtcttgaactcctggcctcaagtgatccactcacctcagcctccaaaagtgctgggattataggcgtgagccactatgcccagcaactacggaaattttgaagtagtgatgaacgtaaaccttatttcaagatacatgcaacaactgtaatgagatagaaaaatatttggtttgttctattggtaacaaaatcacaggtgctgttgggatttgctaataatattcataattgagggaaatactaaatttcattgagaggttacaaaaagtaaatatgtaatattttcccattcaagctcatggatcccctcagttcacggtcccttaggctgtggaccccaggttaggacacctgcagtagggtgtccagactgcttcctaggtgagagagcaaagggaggctcagagaggtggagagattggcctagagccacacagtgacagtgagagtggcagtgctgagactgggactcaagtcccccaaatggtttcagtctcttcagtaacattgctttatattctcaacagtccatcccttactgggcctcagtttccccatcgttaatgtgaaagagttgaattagatcacgtttctcaaatctctttggccaccaggtctagtctcaaaagaaatctcatgtgccgggggtgggggagccctggcatccatgcttttcccactcttttccctctctgcagttcccaggctctaaagagcacagttagggaacttggcaatctggagtttctcgattgggtttatacccagctcccaggatcctggctgttcacgacaatagactccacgggctcacatgaatgcctgagtgccctgctgacatcccaccaggattccttctgctgctgcccagcccaaagctccatcccagcaggctgcggaaaccaaacccgccctccagtctgtcccctgccaaactgcatgtagagtgccctgcacacgtcagtgctgtgcccctgctgagagcatctcccactgctcacaactgccccagcagtgccggcctcaaagagctttctctgagagtcaggaggttggatgggctggggcaacgtgctatgtggctctgagcaagtcttcctcatcactgagcctcaacgggccactagtgcaaggattttccagatctcacagatgagtttcttaaaaacaaattcccaggccccatcccagactcactataccagcatttccaggaaactaggactagggactaggaagctgtttttaccaagaacctccgggagctgtgatcctcaggaaagttaggaaatcccccactgggagtgaacctggctggtcatcagcagtacgtggagagctctgaaaaactgcagatgcccaggacccagcccagagattctagttccacagatccagggctctgggggccctagaatgtgtattttctgtgtttttctagaccttcccagggattctgatctagccagttcagaggctggcattcagaaaccaccggactggatgatttaaggtgacttcttgctctgacatcctaataaggacatatgggactacaactcctcaaccacagcgtgcagatttgcttgtgttgatcagttattgattttttggtttgttttggctgacacaaatattgaaaaatgttttagtcaattgccaatgtttaggaatcacatgatcttgtacaaaaatctcaattttcagcttttcttgaaaagtcttatcatccatccatgtcaggcttaaattgctccctggcagaagtggctggggtggagcagtgagttccctttaggaagggcctatgctccccggtcctcagtccccaccactccctattcattcccagcactgtggctgcaagtaggctccctttcccatcatgcttgtgtttcctttcactcagtaaagaactgagtctctaacaaaagtgggaaaacaagagatgggccaagaagccccatgtttcaggaaaaatctgtctccctacccacctcgtttgctcatttatgttacctgcctagtccatggcatttggtatgtgacccttggctactaactgtgagggggcactaggtgctccaaagtccaggacagtggataagacaccatccttgccttcaaatggagaaatggccggacgcagtggctcacacctgtaatcgcagcactttggaagaccgaggagggcagattgcttgagctcaggagttccagaccagcctgggcaacacggtgaaatcccatctctacaaaaaatacaaaaattagccaggcgtggtggtgtatgcctgtagtttcagctactctggaggctgaagtgggaggatcacttgagcctaggaggtggaggttgcagtgagcagagactgtgccactgtactccagcctggatgacagagcgagactctgacccccacaaaaaaacagaaaacaaagcagaaaaatgggtgtggtagacccaagacccccactctggcacagtgctgacaaggtccaagcaaggggaagggatggcaccttatgaatgcgttggaatgaagaaaagtttcatcaaggaggatgcatttgagatgtcccttaacatatgttaattcaacagtgaagacaaggagggcctcttggtggtaggggcactgtgtggtaaaccctcagagaagtggggaaaagccaaaagtaagaatgggcaacaagaagtttaatcttggcccaggcatgtgttttgtaaaatgggagacaatggatggacaaaataatgcactgtcaagagcgtgggcttgaaagtaacaagacccagggaatccaccactgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttagtgaaccactgttttataagtgaccaatgcacgatgttgtaatatcatgcaagggtggaagatccaaagttcaagaaaaaccaagatttgatggagtatcaaaaaagaagcctaggcaacatggcaaaaccctgtctctacaaaaaatacaaaaagttagccaagtgtggtggtacacacctgtagtcccagctactctggaggctgaggtgggaggatcaccttagtccctggagactgaggctgcagtgagctgtgatcacaccactaccttccagcctgggcaacagggcaagacctcatctcaaaaaaatatatatatccacaatgatctaaaatggttatctgtatgagattggcctttgttcacattttttcaagaaaatatcacacaataaattgaatgcagaagcaaactgacatatcaatttgctaatgacatatcaaacatcatgcaaatgacatatcaaacatcaaaataatttgcaaaagatgtaagactgtactactttgggtttagaaattttcttttcataaaagcatttataacaatatgtggtgagcttttaaacaatattttaaatatttctgatttaatttctagtgataaataccaatagatataccctacataaaccaaagctccttgggacctcaatgtatttttaagagtgtaaaggaatcctgaccccaaaacttggagaactgctgccttcccctccactttcttccttctctagaatttcttccttggaagaaacatccctttgccattctatattaacttacatagttccactgaggcaagttttgctacctccctcccatctttccacctctctctcaacacaaaacctgaccaaagcattctaccagcccaccccatttccagtgattagctgtcaggtgggctaagccaaacaaatctgggttttccctgagactagacctctctttctgggagagatggaatcacagggacaaggttggccaccttggggtagtgagaattcatcctgcctaaacagggagaattcaaacaagtttctagaaagccaaactactttctagaaagtcaaagataattatattttttgccatgactgtaagaatgcccatttcattgcacactttctaacatttttaccaatctgataaataaaagctggtactgagatgaaaaaaaggctgggcacagcggctcacacctgtattcccaacactttgggaggctgaagtgggcaaatcacctgaggtcaggagttcaagaccagcctggccaacatggtgaaactccgtttctactaaaaatacaaaaattagccaggcatggtggcatgcgcctgtaatctcagctactcgggaggctgaggcaggagaattgcttgaacccaggaggtggaggttgcagtgagatcacgccattgcactccagcctgggtgacaagaacaagacttcatctcaaaaaaaaaaagaaaaaaaaaagaaaaaaaaagttcccatacaatataatttcttccatctctggaaacaaattcagcaatgagaactgaaagtcaccacgtggaaggtttcaaggatttacgtctacctactgatgtctaaagcattagttaagttacaaaaaaatacgcacacacgcgcacgcacacacacacatacccgtatgtattcagtaccagaaaacatgactgactacatggtaaagtcatccaacagaaagcacacaataactgaaggcaatgtagaggagtaagttataacatggatctacaatactgttgagtgaaaaagcagattacaaacaaatatctgatttttaagggagaggaaacatatacaagcacaggagaaaagaggtgagcagatgactggaaagatacaaatttctgacagtggcaccttctgagtggtagaattacataggtaatattttctagttttgcctaaaagttttctaaatttcttaaaataagaaggttttgttttccatattacaaaatatccatcaccccaggaaatttaacctttggcacaaactctacaacatgttcaaagtttgttcagttgaatatttaagagacaatctattttgaaagacatttaaaatgaccaatatttaaacctatgcattaatatttttcaatcacgttttaaattttgtaattttgataagttttagatccatcttgaaaagataaattttctgtttgtctttaaaatattacctacaatatgcctgtttttatacagttaatggtgctcaaaaatcgcaatataaattcaggcagtgttccttctatagaatgtgtaagtgcttctaatactgctctttttcaccagttatgaaaacacggaacaattatctaagcatctaattattcaggtcctttgtttctcctccattctgttagttttatactaatttcaaggcctgtgaggatgaagttgtctgtgacagctaccacaaaggttactataagcagacaaatttccagcaagtttatcaccactaccatcccaccataaaactgtctcaatcaagggcaacacaattcaaggttagtcaagacaacctctttacctgtcactgcttaagaaaaggattttttggtcttatttagaaataactttatctatttttctccataattccactgagaccaatgtgtgcctctatctcaagcaccagcaagcaaaactgcctgccagtatgttcagtttttgtatctttccaaatgtagggcacagctatcttttgatatcataattttttgaaaactgatgcacaaacttcttcttgaaagttcagccaggtgcggtagctcacacctgtaatcccagcactttgggaggctgaggcaggcagatcacgaggtcaggaattcaagaccagcctggccaacatggtgaaacctgtctctactaaagctacaaaaattagccaggtgcggtggcaggtgcctgtaatcccagctactcaggaggctgaggcaggagaattgcttgaacctgggcagcagaggttccagtgagccaagattgcaccactgtactccagcttgggtgatagagtgagactccatctcaaaataaaaaataaaaaaaagaatttcagatatacagcagttgtaattcttctgaaggctgcttatgggacacattactttcataatttgctgttcaataaatgtggggtggagaataaagtaaattgacagaattaccatataaaataaaattctaagtcctctgacaacaaaaacttacacacacacacacacacacacacacacacacacacacacacacacagctttccctgctaatcattttacaacaaccaagtagctaacccagagcccacaaaagcagagtcaaaattctaacacttggtaaaataaaaatgcacatatatccctgtcacctaaaaaaaaatgcttacgtattcaaagacagcaattgtagctactgagaacatcattgtaagcaaactgaggcagagaaaacaaacgtgctgatgaggatttgaaacacctaagctgcagaaacccactggatggtttcctaggttccgagttggcattatctttcagaacgatcttctagaagagatcacataacactgttacaaaggatctggagaaagggaccctggcttcatcactctggctctccagtcatgctttacattttcacttcttacactctctttcataggaagtcaatttacaggcttccaccaagcccttaagtgacgtttttgtactatccatgacaagttcttgatgttatgtctgcacttctgacaaattcttagcagttaacttactaggcagttaaggtttttgttcaagcacaatatagctagaatagggtcatacattcaataaaacaaatatttaccaagcatttattgagtggaagataaaaagcacaaagcataattataaaacattctcccctgccaccataaaaatttttttaaagccttacagaatatagcataacataaccaaagcaaaaataggactaaagaggggaggaaggggaaatatcagcatgaattaaatatgacccagaagagccttgatggtcagacacgtaaagacaaattgggtagggttagggggtggctgtcaggggcacattctacaggggaaaaacagctgatacagaagcctgaaaggaaaaccgggcagagcacctggacaggactcttacctgctgcatccagggtacaatgcgcctttccagaacacagcagcgacccggggtagagggatcgctcaaacagcaccagaggctgcattccaacttttcctccatcaacgagtccgttttcattgttagtttctccttaaacacgattggctgaacatgcgggaacaaggaaaacctgactgaagaacgaggcatttaagcttaagggccttggatctgggcgcggtggctcaggcctgtaatcccagaactctgggaggcagagatgggtcatttgaggtcaggagttcgagaccagcctggccaacatgatgaaaccccatctctactaaacaacacaaaacttagccaggcgtggtggcgggcgcccgtaatcccagctactcgggaggctgaggcaggagaatcgcttgaacccacagactgtcaagagatggaggctgcagtatgccgagatcgctccactgcactccagcctgggcgacagagtgagactccatctcaagaagcgcctgccaccatgcccggctaatttttgtatttttagtagagacagggttttaccatgttggccaggctggtctagaactcctgacctcaggagatccagctgcctcagtctcccatagtgctgggattacaggaatgagcactgcgcccggccaaaaaaccgaaaatcttaaaggcctttccccttccctcactgggctcaaacaacagcgggagccgccctgccacgccccgtcgcggtccaggggagcaggctagctgactgagggcgatcatgggccccaacaggtctgcgggcgacgcgggctcccacctcagggcgcagcgactggggcgagaggtgccggcagcccccaagccagccccgcggcaaggagccagagagacgcgccctccccctcctcccacgcaagcctcacacagcggggcgggccagacgcgggagaaaggggcgcgctcgccccgcctggggaaccggggcctctcccgggcaggctcccctttgtcccgggactctgggcgcctcctctccgccctcgccctggcccgtgaggccgccactgggcgcctcaccgtgatgttgcagtggagcgtgagctgtggcgggggctcctggttcttgtggaagatagaggccaacaacctcagcttggccttgaaccctcacacggacattttactctcacctctggcgggaggggcgcggaaggtgagcccgtcgggagccgctgtcacggccgcaaccacccgcgggacctctcggcggcgctctcccagctccgcctctccctgctgcctcaactctattcggagtagggctggaaaatggcaaggggcaccgaggcctctgcggggagctgtgtggcggcctgggcggctgctccccttgtaacagactccaccgacaggaggcgctgctcctgtcaagccgcagcttaaaagggcaacagcaccacagtccccgctaccgcctgggaaagggctgcccctaccccgctcccgtccctctcgcccctcacacccgtcgcccctcacccctcaacccgcgcgccccctgcgcacccgtttcggcggctgcaggagtccagagcatgcgcgcgcttccggctgccccctcctcgccttgacccagcactgctggacccatctggtccgttcttcacactcgcggactggaggctccgggcagcacaaccaccaactcgtgtgtgtgttggggtgggggtggggggcagaaaaccaccaactcgtgtgtgtgtgtgtgtgtgtgtgtgtgtgtgtgtgtgtgtgtgtgtctcccaagggaacagcactgctgagttcaggctatcagctcatggactgtcagcaaaatacagtcacaagaaggctatgtgctgttttgtctcttgcagtgacgtcatgttgctcatgttttatgtttttcagagttcattagtttctgtttgctctcagttaatatccagctcaatagattgtgtaagtagaatacccccaaactgaaagtcacctacataaaatatagtgaaaaatatgtcacccacttaaactatagttgaaaatatgtactcattagttttgtgtagccaacactggataatgggtaaggggaaaggatcccagggctagactgcctgggttcaagttccgatttcctgctggctgtgaaatacttgacagcgttcagcctctgtttcttttcttttttttttttttttttagcttaatcccaaatatgatagtaagtctcagtttcttgatctgaaaaacagaaattattcaatgacagtctatgtgaaaactttaaagttttcaaagccactatctagcttaggaaagtcctcagctttaggggttaaagtttttaaaaccactgcctggttcaggaaagccctcagctgtagccattattagctatgattattattgtggtggctacacatacattaatgaggcaggaaaatgctcaaggataacaagcaagtatccagattatctcatcagaccaagacagatgcatatgcatgcatgatcatgttttagctcagagccatttgtctaaaaggctcttgaactcagaggcccaggagtatcaactttgctttgcagtggagccatcgcttttgttaatcaatgaaattgacataatgctcttcttttttttttcctttttagcaccaaccatgtgcctagagctaagtgtgttaagaagagcatgcttcaagtggctggagtgagcaattcaacttgtggaggaatgagaagtgacagtgttgagacaagcaacataaaaccccagggtaaggtagaaatcactgaaagtcaggcaaaggaactggcgtccagtaatgagtcaggctttgccagcctctggccctacagatggctctttgcagaggaaaaaattaagccaggcccgagggcacagatcctaagggaatgctggcagctctaggctgtctatgagagtccagagatgctgcttcaccctggggctttaggcaagtccctttccctcccagagcctcagcatcccttctagcaaatgacgttctgcctttctcctaggatggctgtggggatcaagggagacagtggccatagggatactatgttaactgcagatgcggctgtaggagcactttgctaacttccagcgtgagttcagactcttcaggctatttggcacccagatctatggtgaggtgtgacatatgggatgtaaagtttgatgcctgctccgactccagtcttgctaacacacacgaaacctttggtaaatcatgaccctgccttggggaaaagggcagtctgggagagcttcttcaaggcagcctggcttcaatgcagtctggggcatgactgaggtaggcatacatggtgaggaactggagggtaactgggtaaagagctgcagtgtgggcagaggtgtagtgtgggtcacatcgcggatagccactggccaaagcagggaacagagacagaatgaggaagagctctgtggggagggtggggcacagggtggagaaccttcaaagtccaaagagtatgacttgttgggattcaacgctgtaggcagtagggagccatggaaggctctgaggtggagaaatgacagccggacattagtgagcaagccctgtctccgtgagcagcatgggtggtcctctgagcacgccaggcacgagtgtgcagggagctggtgcaaatgcctctgtgtgcgggtgagcatctgtgttgtgactctgcccacgcatgtgcttcagtgtgccgagtggctgcacgccccagatccatgtggcacgtgccggccggtgagggtgctgggcattgggaggtggcggggagggcgacgtatgcgtgttgtttgtgggcatgtgtgttagcgtgtgcatgtgggccgtggggcctcacagcatgtgtgtgcacactccggcatgtgcgtgtgtgtgtcccccacccccaggcctgccccacccatgcatgtgacctgccatgtgatttgaagctgtctttcagaatcactatcagtggcccctgaggagcgtcagccatggtaggtacatgcctcactgcctgctgcatgaatggtctgcctgccccgctgccccagctccacacagggggcatacctggagcctcagagccaggctccctgcccctcccttctggagctgcagacttgctctttcctctttctgtccttgtgctgctggctgtctcactttgctccctgtgagccacgggactcactgccactgctcaaggtctccatggctgagcctgggggctcttacaacaggctccatgcccaaggtggcagatgtggaaccatcagagagggcacagagctcatggtttatggtgtaggggctgggagcttggagggggttgtgtggggggctggactcaggcggccagaggcctgggcacatcatcctgggcacgccgtacctgtcatgcagtctgagtcatgctgccagggcaggtatccagctcccagcctgggagtgccaagagccaaatccactgcagattaggggtgatagtcacggtcccacgtcctctatctgtcagcaatccagtggtgatctaggataaaagcctgagagtcctatacacgcggtcatcccacaacacacttcataggccatggaaggacacacagcccccttccctccctcccaggtaccatgatagctgctagcgtgcgactgaaggcagggtccctggcccctgctgaagcactactgctggccagcaggctcacgcaccttggcctgttgcttctaggggtcgcctgtgctattcagccaatagtgctgctggcccagctgagctccacctagagagctcacttccctttcctgccgcggagtctccctcttctgcttttcccagcaggaagggcccagcctcacctatgtaacctgcagccccccgccaaccagttgaggctgccctgttagacttagaagtctatggccaatggcatctggctacctgccctccctgccttccccagggtccctcagaggaccctgggctttctgatggcccagaggggcctctggcattcactccagccagccatcccttatagctccaccattttggttcaatcagtgttccttctctatcaggtctggtggctgttggatggggctctccaagcaagaggtggccctgggccgtgagttggaagacagggtgaccagagaagagagaagcccgagggggctgagcattcatctgaactatgggtggactgcctgggtgccatgaaagaggccagcgtgtgtggggtggggagggccgccgcagtccccaggcactacctatgaagctccggcttctccctccatcttcctcccctttcccttccagcccctcttttccaggaaccttgccatgcccacacctacgccctcccctccccggccctccacagctgctgcagcgcacccatactctgcacttgcctcaccagctctggcttttctctaacccgttttctctctgctttctctccaactgccagctgattgggtcaggcaagtccatcccatccggggagccccaggccccacttcgacctctaaacagattcctcctcttctcagagacctccctttccaagcctgcctgggtgggtgtcctgtgacttgacagtggctcccccagccccaaagccagcccccttcttctgtgacttagtctgttgtagtggtgagctgacacgtccaggtttgaccgttgctgaaacttgtgccccctctgtggtatgcccctgccctgttctataaatagctataaattctctctcacacacacacacacacacacacacatatatacatatatatacgtggccaactgcctcgcctctagcactgggaatcagtccccgtgctgtgcttgtggagtcttgtagcccagcaagaggaagctgtctcctgacatcgcccctccaaagtgcaccacctccagtgagcttccgggacatgcgcggcctgtggacagccagcccccgccatccctcccgcccttctggccaagcatggcggtgctgtgcaggcagctgtgtggcctgacagtctctaccagtcctgctgtcccttggctgagaaacccatttctggatgacagagaatgtgtcctctgctggctgtgttctctatggagctcaggggagggaaaaggccaagccatttttagggtgctgttgggagcagtgaaaaggtcacacccttttcaagggacacttttcctggaaagtccctggagcttagctggctcttaccctgtgaagccggctctggccactaggggacagggccctgaactcagcctggagggaacctgcggggcagccggcactctggagggacagacaggccacccggtgcagacaggagagggaggcagggggacagaacggaagacacctggggtggatggaagtcagtgcccttgggcactggtatctgtcttccctgccacagctagatcaggcttctcaaccagttggctgtcagggccagagtgtactccgtaggcgccatggcagtccccatgaaatccaccaggtgtcaccaggcagcatacaggtaacaggcctggaaggtccccaacagcccagctggacatgctgagacactctggggctcctcattcagtgggacaaactgcaggacccagtgagggaaatgggaacataccaggccgagcagtatggctaaatccatttattccaaaatcaaaagcaaaaaaaaaaaaaaaaacaggagtcccatcaccagggagccatgaccccatccccgcctccttcctcgctcctatgctagcaataaataagtttcccagtcgcgaataattataagaacctcttcctcatatgccagctgcaacctccgctaggtacgatacagaatgttacacagctacagtatgtacacgggggaaggggggccacccccagcagcctgtgccctggcctggtctacagttaactccactgtcccgcctcagctgcctctctgagtaagaagatgggagcccccctgagggaaaagttgctttggtgagagtaagaaggccgtcagacctcctccaaacaaaccaactccaccaacctctggctcttaaataacaaacatcatcatccagaaatgtaaggactcagccttggtcaaggtggtaaagggtctgtttgtctccctccattagacaggggtcttgtcttgctaccctaatggtaaagggctgactggggaggggttgtagggacatggtgggggtgaagactccagacccacttctccaggcttatgctgacaggggcctgcttttatttatttttatttttatcccatgatgtttttttaaatcccgtaacttctttttcagaactttttaaaaaaacttttcataaaactttttttttttacttttttcccacatctttttttgccacaacttttccacagtattttttatcccgtaactttttcatcccacaactttaattcctgtaattttttagtttgtgttcttttaataaacacacttacatggttacaattttgtaagaataaaaaccgattatctcatgccaagcatgcccagcatttgcacagtctcaatacctttaatactatagttttcaagacacacaaaatttttaggcaaaacagcaccttgaaacaatctaataatttattacattacagtagcatcacagaagcagtcaataatgccactttagacaaaaatcagtatttccatcatgcattctgtgtataagaattcataaatcggtaaaagtcgttctaagaaaacttggcaaatacagctttggactggaattggcatttctttctctacttttccttcccctagattctttgttttaagctacagtattcgtattttaaaatgttttaaattattttaagacattaatttaacagttacatttttgaatagttatttgaaagtgactgtaagataaagttttagagaatctattttggatagggttgatttacattttcacattttctaaaaatcagctttggttttagaactgattgtttttcatttcaggaaaacctatcaggtttaatctattactttaaaaataattatcatatattgcagtctttaaataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttatcagaaagaggacaacccaagcctcatttcagagcaaagtctggtatacgcttggaaacctatgtgtctgtcacccccaagtacattaatgcattttctcaagagaatcaagggaaaatgatgcttcagaaagatgtcccgcatttatcctgtggcactcaaagtaccccaggttgagacgatatgaggaagattcaagctgtcaagttcagtttcccaagatctattccacagaagatgagcaaatctcacttcagaggccactgactgaagggcagtctggtcccagaaccgtggagaactcagaaaaaaatgttaaagtctctctggaaagtagaagcctgggaaaaaaccaaaccaaacccattctcccattgccacccagagatactgtgaacattttgagctcacaggggaagtgtaggcttttcccactgtcaatgtctatgttaagggagtaaggcagcctgaaacctcttgctcctaggtcccatagtctccactccccttccagctggaaatttgtgctgcaaccagaggaaccagaaatggggtgagaaaacttaggggactgggttgtaagatcaaaggctggtcttgcagcagtaatgacagttcctaggggcactgtgacatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgttgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaacttacagttagtatatgagagcagttctcaaaaatgtagtctctggactagcagctccagcagcacctgggaacttcttataaatacacatcctccggccccaccctggacctgatgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagattttgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcatgacacaccatcttccaaatctctaaacatttctctccacagcccagtcctctccatagttgtccaaatccctccctcttttctcttgttgtctccaaaactcaaaaccatgctctgactttctatatcccgccctccccttcttggaccatctgggaagccccctgcttccccagggtgtcccctcctccccttctgggatcagtcatctttcctcaaatggaccagttcggcctctcttagtttctccaactctgcatctcaacctttctcccttcactacacaataatgtccaggaggcaaagagcccacaaacctgggaacctccctttccagaagggaggttctggaatgactacaaatatttggttatgattttcttccctgccacgcctgttttcatgggcagtgctgagccccggtcctggcagagctcagaaccaggctctcatgagctggggcaagtggggcctagggaacctctgggttgaggaccttgcaccccactctgcagctgccctgctgatttggctcatgcaacctctcctcctgggctcaagcgatccttctacatcggtctcccaagtagctgggatttgggctaccacgtttggctaatttttgtatcttttagtacagatgggggtttcacctgtagcccaggctggtctcgaatcctgggctctagtgatctaccctcctcagcctcccaaagtgctgggattacaggtgtgagccactgcgcccggccttgtgccagcttttaaatatcaacaaggacaaattagagaacagtggaagagggtgagcagcatgatgaggtgatacagaaataatttcacatgaagaactgggcatgcctggcttttttttttttttaagctattctgggttggatgctgaggctcacacctgtacgcctgtaatcccagcactttgggaggccgaggtgggtggatcacctgaagtcaggagtttgagaccagcctggccaacatggtgaaaccctgtctctactaaaaatacaaaaaattagctggaattggtggcatgtgcctgtaattccagctactcgggcagctgaggcaggagaatcgcttgaacctgggaggcggaggttgcagtgagctgatatcgtgccattgcactccagcctgggcaacaagagtgaaactctgcctcaaaaaaaaaaaaaaaaagaaagaaagaaaagaaaatatatctatgcaccagagctcaacactaggttaggagcatttctgagatttggagctattcaaccatggaagttcctggcacatacatcaggtattcacaataccctttctcaggtgtttggtcactgctagtgagcctgcctggatcagtgtttcccaaatggcagtcatttgcatctttgcattttttttggggggggggttgtgggggtatataccataccagattttttaaaaattcacattaaaaatacatgtataaaatgtgtaaagtgcactaatctaaagtgcactggatgtattttttattgatgtacatacttttgttatccatcacccaggtcaaaatacagaatcagcaccacagagggttccctcctcctccttcccagccaataatcttctcctcctacctaaccaactgttcttacttcaatcactgtcaactagtattttacattcttgaactgcatataaagtgtctcaagtttcacttaacacttttcttgaaatacacttgttttttgccactttttatttgacctaagaagtaacattaatgaaacaatgatttgacgtgataggcatttccctcctaatgagcactaaaacacttaactatttgaaaaaagaagtttctccgtgtaccagctaatatattctcctcggccgccgttggtacacggaccacattttgtttctcaaagcaatccgatgatttctgaggtcctttgcagcttgaacacggaacgactgtggtgatcgagtagccaaaagttcacggaatgcactgtcacaattgtgattccgccatagcgccgtgcatccatccaacacttgtttaatacctatatttaatacctaataccttagactgtcctaggctgtggacacagaagactaaaccccacttcctgagttgaagtgggggaaatagaggagtaaatcatttcacgatgtgtggttaaatgctacagctcaggtaaccacgagcacacagagaaagggcagtttctagaaacagggcggagaggagaccgtgagtgggcatttcccagagcagtctctgccagccaccctgctgtgatcactttgccacagagcagccccggcggtcaacctcagcctcccttagcaacctgagcgccccgcccaggtgccttactattggtctcgtggagcgggatgggcagctctgccgtgcaatcccagctcgcagcccttgccccgcgtgtactcacgggaggactcgcagacgttactgccctcttgcgtgccccggccacccccgggcggcttgtagccggtgcgcggggtggctggggctacgtgcagagctgtcgcggagccggaacagcagcggtgaagcccctcggctcggccgagaccgccgtgcccattgctcgcctcggttgccgccgctttagccgcagccgctgctgccgccgccgggggagaggcagcctattgtctttctccgcggcgaaggtgaggagctgtctcggctcggcccgcgggggagccccgggagccgcacggtgagagcgcaacttagttggcggagttgggggaagttttgtgatttgaggaggggtcggggtgcggagcgcggcccgtcccctgcggccgctcggtggggcgggccccagaggagggtcgggggctgcgcggggcttcaggggcgggcggcacggatgggtagccgggcggcgcggggacctcagctttgcggacccctcctccctgcgcatcacccttctcccgcattgtctgcttggggctcggcgcgcctcccactccgcagcccaacttgggggccgtcgccgctttccggatggggggcgcgcccggcggcggatggccccgaacccttgccccgggtccccgggttggcgccgctggggcggactcactcctcccctggggcgggcggccgcggtgtggagtccgcgccgcgaacaagtgctgcgggcgcgagggagcggttccccggggccgacgcggacggtaaacctgtccggcggcgcccgcctgctggggcctctccgctgtttctcgcgggcgcggcccggctgaaactgcgaccgtcggaggcgagcggccctctgggacccgtgcagccggtccaccttgcagctatactttgagactaaacattttttttttttttttttgcaaaggcaaaccggtatgtgaagttgaaaaaagcaaaaaccctcaaattttccttctttcttcttcttttttttttttaaatcaagaaagggggtagataggtttgttttgttttggaaatagtttttatagcagagtgataccgtcacatttaatgatcctactgtgaattcaggaattcacgatgaaagttggattgagcggtattttggtgttcattctttgctgatactcattaatgaagttagttggagaatttattgcttcagtacagtaaaaaccagtgtgcctttttttttgttactactcccccctccccgcattgttttatttttcgaagaagcactttattcagtttttctaagccacgggattgcccagatgaggaccaacggtgcagttcttgaaaggtcattattggcaagtttgtgagggagctaagatgagttgagataaaccagtgttactgttcttgtattctgtcgtggactcttggggatttgcaggctgcattaagtacaagtctggtccagttttgggtgcacgtattccactgaatttggttcgtctggcttattatatgaacatgattctgtttcacttccccagatggaactagcttaaatgtctatcatttatagtgacaaatgatcaaaatggctagagtgtcatttattaacttcagttgtagtcctttaccttaccttctgctaaatgaaaaagaaaaatttgacaaatactgtgtgcgtcagtttgctctgagtgatttctcgtgctaagtgagtcctgtggagaagcgttcctgggcttttctggtttggtgggccttgtgttataaaaccaattttcttcacctgatgaagctaaagacaaattttcttcaggcacaggcattgcccttttaaactacagagccacttgtaggattcacaatactcactcaatggcttcccttcctggcagtgtggttttgtgtgtgtgtgtgattgtggggaaggaggctgacagaggttggaagggattgtcagggagggacatcatgtaagcaagtactaacaacataacgtgacgagggcaccagttgctttccttctgtgggcggtgatggcatgttatactgtaggtactattgttgtaggatttctcacagttcgtttgccttgactaaatggtaactgcacacatactatactataaatggactcctcctctagtcctttaactccttgagggctgtgatagaccttatttaactttgtaccctctttgccagtggttttaacatagtgcaggcccggtatgtgtttgaattgggtaaattacttttactgcctagtggtagctggtgtacacaggagagggccaccaactctggggacttgtccaaaatgacaattcacttgcagatctctgatgaaatttactttaaaaggacttctaaccttttttttaatctgtcggttattttttgaaaagaagtggggcttaactagtgctctaaggattttaacaagagattccgatttagaaatctgttcccccttttggtgaaattattattttttttagagtcagaatcttcactgttgcccagttgtctccccgggacccaagccgtcctcccacctcagcctcccacagtactggaattacaggcgtgagccaccccacccagctggtgaaattattaaaattgtagtgaaaactctgcctccattgtgaaattggaaaaaaattagaaattttagaaaaaagtacgccctttggagctaggtagagttcagatccccacatttccattgagtagttgcatagcctctcagagcttcagcttcctactccttaagggttagtaacatgctttgcagtgttgttaggaatcagtgaaactgtgtgagatacttaactgcagtatctaacatggagtaggtagctatttcctggtagctgtaatgataataattttgatacgtttttacatgacttaagcattctgaaaagtctgatgcttctgagtatggaggcttagctatttctttcataaagaaggggccctgagacttgtgagtcttatccaaatgcgtttcttcaaaggtgtcagatgaactgaaggataatggaaacaatagcaaatttatcttctcagtcacctgtgagtcttcctttgagagtgggacttgcagagtacttggtagggtagagctctttgtgactatgctatttaggaaatggtgagagatggattgttttcagtacatcagtcataagaggatatgagtgagttccaactttccttattttaccttagtcttgacaaataacaagtatggattatgtctgtatttctcagacttgtttaaggtagaactggactgggtgttaacagtgttagttcagcagagacatgagcaaatcactcacttccccttcaagataacactttaaaggtgccaccatttgcagaagaaagcagtgatttaaagcagctatactagcacagtttagaatacttacactagctgatggagtagatacattctagaaatatttacctgtagtgggagttgaacagtgagaacacatggacacagggagtggggaacatcacacactggggcctgttgggggttggggggctaggggagggatagcattaggagaaatacctagtgtagatgacgagttgatgggtgcagcaaaccaccatggcacgtgtgtacctatgcaacaaacctgcacgttctgcacatataccccagaacttaaagtataataataagaaagaaaaataaatatttacctgttaaggacatttctgtgtattttattccatctttccaatagttttcttatgaagagattatagttaacctttgaacttaacagattgagagggtaaacctttaaaaaatatatttggtcacacttacagactgagggtaaaaacattcctgacaaagctaggcgaagacacttggacttttttttttttttgagacggagtctcgctctgtcacccaggctggagtgcagtagcacgatcttggctcactgcaacctctgcttccccggttgaagcgaatcttctgcctctcccgagtagctgggactacaggcacacgccaccatgcctgactaatttttgtatttttagtagagacggggtttcaccatattgaccaggctggtcttgaactcctgacctcgtgatccacccacctcagcctcctaaagtgctgggattacaggcatgagccactgcacccggctgaaacttggacttttgatgtttccttcttttaaagttaacatctagcacttgaatagacttggttattactgatggggacaggcatccatttggaagtagcttccctctctctctctttcccaggttaggctgtcttattgctgtaaatggggagagaagagaaagccgtgggtggaagaaagtgtttcatggcctggtgcggtggctcatgcctgtaatcccagcactttgggaggccgaggcgggtggatcacttgagttcaggagttcaagaccagcctggccaacatggtgaaaccccgtttctactaaaaacagaaaaattagctgggcatggtggcgggcacctgtaatcccagctacttgggaggctgaggcaggagaatcacttgaacccaggagatggaggttgcagtgagccgagattgcaccacttcactccagcctggtcgacagagcgagaccttgtctcaaaaaaaaaaaaaaaaaaaaaaaaaagtgtcccactcagttgcccaggctgaaacgcagtggcaggatcactgctcactgcagccttgaaccaagcgattatcccacctcagcctcccaagtagctgggatcacatgcatgcaccgccatgcctggctaatttttttatttttgtagagacagggtctctctgtgttgcccagcctggtctcaaactccctggatgaagcaatcctcccaccatggtctcccaaagtgtagggcttacaggcgtgagagccaccatgcccagcctgctggggtttttgattgacattgcattgaagctggaaatcagttaggaggcaactgacattttaataatgagccatgaacatggtatatctatgtatttagaccttagatttttcgtcagtgttttgtagtttttagcaattggatcttgcttgcattttgtaatcttacacatttatttcatgtttgtggtactgttgtgaatgatacttctcaatttccagttggtgattgctagtatataggaagatgattttatgttatatgctgaccttggattctacaaccttgctaaactcatttttagtactagaagcttttttgtagatttttggaattttgtgcatagacagcaatgtcactggcaaataagggcagtttaatttctttgttttcactttgtatacttttatttccttttttttttttttgagacggagtttctctcttgttgcccaggctggagtgcaatggcgtgatctaggctcgctgcaacctctgcctcctgggttcaagcgattctcgtgcttcaccctccccagtagttggcattacaggcgcccgccaccacgcctggctaatttttgtatttttagtagaaatagggtttcaccatgttggccaggatggtctcaaactcctgacctcaggtgatctccctgcctcggcctcccaaaatgctgggattataggtgtgagccaccgcttccggcctaagaggacacagtttctttggcttattaagaggtatttggttagtgttagaccgggggttggtacattatagcttgctgactggatgtaccatgctgcctctttttataaatgaagttttattggaacacagccacacccattcatttacatattgtttaacagagaccatatgacctacagaccctaaaatatttaccactttgcgcttcgcaggcattttgctggctactgctgtggacaccaattttaatttaggtagataaacttttttgtagcttctgaggttttgcattaatttgctcaggcatataggttggtggaagtgctttctgttccttctcccaaaccaatcacacagccatataacttcatgcctgagtttctgtgtggtcctctatagtgagtgagtttttacatacttctttgcagcagcatgaatttcaaaaatctcaacgcttttgctcttgctaatctttgtaaactttgtacacccagtgctggtacattctgatgatagtgcccacactgcactctatgaagaaaagactgatgattgtttatattaaaatgcaggaagagaattgtagcggcaacttttgcttctctaatcagcagcatcataagagacttactatgtgtgggcaatgggggaaaacgttaatttatacattgagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacgaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcgggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaattcaaatacgactctttgtgtaggtattttgtcatatgtttaagaaaaagctaaagagaatggaaatcctatgacaataactcaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataatagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactgtaatgtaatacattattaaattgtttcaaggtgctgttttgcctaaaaattttgtgtgtcttgaaaactatagtattgggtattgagactctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaagttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcagccctttaccattagggtagcaagacaagacccctgtctaatggagggagacaaacagaccctttaccaccttgaccaaggctgagtccttacatttctggatgatgatgtttgttatttaagagccagaggttggtggagttggtttgtttggaggaggtctgacggccttcttactctcaccaaagcaacttttccctcaggggggctcccatcttcttactcagagaggcagctgaggcgggacagtggagttaactgtagaccaggccagggcacaggctgctgggggtggccccccttcccccgtgtacatactgtagctgtgtaacattctgtattgtacctagcggaggttgcagctggcatatgaggaagaggttcttataattattcgcggctgggaaacttattcattgttagcataggagcgatgatgggggtggggatggcgtcatggctccctggtgatgggaccccttttttgttttgttttgtttttttgtttttgttttggttcgcttttgattttggaataaatggatttagccatactgctcggcctggcatgttcgtgtttccctcactgggtcctgcagtttttcccactcaatgaggagccccagagtgtctcagcatgtccagctgggctgtggggaatcttccaggcctgttacctgtatgctgcctggtgatacctggtggatttcacgaggactgccatggcgcctctggagtatagtccggccctgagagccaacaggttgagaagcctgatctagctgtggtcaggaagacagataccagtgcccaagggcactgacttccatccaccccacgtgtcttccattccgtccccctgcctccctctcctgtctgcaccgggtggcctgtctgtccctccagagtgccggctgccccacaggctccttccaggctgagttcagggccctgtgccctactggccagagccggcttcacagaataagagccagctaagctccagggactttccaggaaaagtgtcccttgaaaagggtgtgaccttttcactgctgccaacagcaccctaaaaatggcttggcctcttccctcccctgagctccatagagaacacagccagcagaggacacattctctgtcattcagaaatgggtttctcagccgagggacagcaggactggtagagactgtcaggccacacagctgcctgcacagcaccgccatgcttggccagaagggcgggagggatggcgggggctggctgtccataggccgcgcatgtcccggaagctcactggaggtggtgcactttggaggggcgatgtcaggagacagcttcctcttgctgggctacaagactccacaagcacagcacggggactgattcccagtgctagaggcgaggcagtcgaccacatgtatatgtgtatatatatatatgtgtgtgtgtgtgtgagtttgtgtatgtgtatatatatgataatttatagctatttatagaacagggcaggggcataccacagagggggcacaagttttcagcaacggtcacacctggatgtgtcagctcaccactacaacagactaagtcacagaagaagggggctggctttggggctgggggagccactgtcaagtcacaggacacccacccaggcaggcttggaaagggaggtctctgagaagaggaggaatctgtttagaggtcgaagtggggcctggggctccccggatgggatggacttgcctgacccaatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggagggagatggagggagaagccagagcttcataggtagtgcctggggactgcggcggccctccccaccccacacacgctggcctctttcatggcacccaggcagtccacccatagttcagacgaatgctcagccccctcgggcttctctcttctctggtcaccctgtcttccaactcacggcccagggccacctcttgcttggggagccccacccaacagccaccaggcctgatagaaagggaacactgcttgaaccaaaaatggtgaagctataagggatggatgactggagtgagtgccagaggcccctctgggtggtccaaaatcccagggtcctctgaagggaccctggggaaggcagggagggcaggtagctggatgccactggccatagacttataagtctaagaggggagcctcaactggttggcgggcgtggggctgcaggttgcataggtgaggctgggcccttcctgctgggaaaagcagaagagggagagtccatggcaggagaggcaggtgggctcgctaggcggagctcagctgggccagcaggcactgtggtccccttggctgaatagcacaggcgacccctaggagcaacaggccaaggtgtgtgagcctgctggtcggcgatagtgattcagcgggggccagggaccctgccttcggtcacacactagcagctatggtggtacctgggagggagggaagggggctgtgtgtccccgcctggcctgtggagtgtggagtgtgttgtgggatgaccgtgtgtatgggactctcacctagataccactggattgccgacagatagatgaggtggggccctgactatcagccctgctttgcagtggatttggctctcagcactcccaggctgggagctggatacctgccctggcagcatgactgagactgcacgacaggtatggcatgcccaggatgatgttcctagggactggttcagtgtgtgggtcaggagcaagtcgacaggccctgctccttaccccttggaagggactgccaccaggggcagttctgactaaggcctgggaacccatgactcagagcgtgggtccccaggtcttgctgggccagcctggctgctgcagacagacaggaagcacgtctgacgctcctccaccctcggtcagcacagcggggctgggactcacgctagccttcccaggaacttgctttcctgcgtgaactctggcaggctgccctctctgtgcaaagccatagctggggcctgcttggggccctctccctctttcacctgctcagagtggcctggaacttggaggtgggcagtcggcgcctaggatgggcctgtgtcactagggcatgtgtccttgggccagttacttcctcttagggccttgggctcctcctctgagaatggggcgtgttggtgtgaaatgaggtgagcatgttgatttgaggagcagcaggacagacacctgcaggcagcccccctggccacattcccctccctcccttccaagtcctgggacagacgctcttcaccaaggggttcagcctctgatgctctttcttggtctcagtccctaaggagtaattttttttcttttcttttcttttctttgagacacagtctcctccctctgtcgcctaggctggagtgcaaaggcgtgatctcagttcactgcaacctctgcctcccaggttcaagcgattcttcttcctcagcctcccaagtagctgggattacaggtgcccaccactgcacccggctaatttttgtatttttagtagagatggggtttcaccacattggccaggctggtttcaaactcctgaccttaggtgatccgcccacctcagcctcccaaagtgctgggattacaggtgtgagccaccgcgcccagccaggagtgattttcagtggtgtcctctccatccccagcatacacccagccctgagtggctgcggctgccacatgcaggctccagggctacatttgcctttcgtccagggttgtcatacgctggagagtagaatgtgagaggtgacccctgtaggctgcagggtggcctctctgaaccttagtgtcccccacctgtagaaggggcgtaacaccttccagggggagggctgaggaggaaattgtcaacggctgagtctaaggctcacagccagaggccagggtcggatccagggctgggcctgggcctgggaggacagtgtccgccccttctccagcctcccgcccctggtcaggccaggaccctcttcaaagcaccttcatgcccatctgttccctgctgtgggcactactgtctggctccatgggactagattttatgggaggggaaggggctgtgggtaggcaggtgccaggtgctggaccatagatcagcatggtaggaacctgttgcttgggctggtggtgggaaaggggccaacccaaggcagtggcaattagcccagccctatctctgggcacagagatgaagggacacgtggggacacagtagggcaaaattggccagcctgctcttcccctctctgcccgctttttgcagaagagtcaacagatagaacagacagagccagggaggtgcccatgggggccccagtccccaccactccagggggcagtccctgcaagtgacaaggtgggctcaatccctgtggaacaggtctctgaggaccacagagtggggccccagggaaggctgggagcctgagctgaaggcaggcagcaagtaagggccaagctgtgcccctgcccagaagaccttcctgcccccagaaccccaccctctgcagacaggcctccctgggcagcagccccctggcttccgaggccttccgtgcctcaccagatgccatgctctcagggactcgtttgctacgctgccccctgcagatctgccccagaggagcaggtgaaaagccgcgcctgccgaggtgctgcagcggtggagttttgggcagaggggtcgggggaagagtttctcacttttaagattccccaaatccaagatgaagtcacactgtgctttagaatggtagatgctcatttatgtaaaatcataataaatgttacacaaactgttagaataaaaaaatacctttttcgagggggaggagctccccagcctgccgctgggtagtgagagggggttagcaccattagggcgtagggggcgggagctccgccacagcccgtggtgggcactgaggtctgtcggtcggtctgtgcatcctggcaccgtcagtggcgggtgacccgctgatggcctcgggagggggagccgtggctgggcggagagcacgagcggcagcactgggtgcggacggtgggcagctggcagcggcccagtaggcgcagtgtctcacagaacccgaaggacaggcggtcccgctcacagcctggagtggggggtcagagaggcatcagaaccagtggtttggggtatccagaacctggctccccaccccaaccacctcaaggaggctccagcagctccccaccaagcagagagccccagtttctggagcggctcccaaactggacttgcaggtctccaactgttggtgtctctgtcccacctactcacggccgaccccaggactcgagaacgggcgctgctgggctgaggtttctggaggaaaggtcctgagaccgcaccctgaccccctcacatgcctgttaaagagcctgcccagggcgacgccctgccatcccatctccatccttgctcacccctggtgttccccgacagatcctggcacagaactgcggtcccggggcctcctgccaacctgcagcggcctctgcccccgactcccgccaccgccccctgccccagtgcatctgtcctgccagacctccgtgaccacctccagccacaggggctgtacacagcctcgggttctgagtcacaggtcgcatctcccaggccagcctcccacttcccaggtgggccaggaagcctagagagagtgggccctacaggctgtcagcggaaaccagggactaagcccaggcccagtggggagggaggccggctgcaggctgtggttgtcagggctgaggcttggctgggccctcctgccccgtggttatcagagctattttgggaagtggcttgtctccagcctcctggccttgctcctgatgccactgccactgctgacagcccccacctgccgcctgggccctgcttactccagcagacctccctggggaggaagagcaggaggacagcagccagccctgtgccagggacatccctcaggcccggcagagggcacgaggcagcaggcaggctcctccaccccagctccaggcagagctccaaagtgcacatctgcaggcctgcatcctggtcgcccggggtgacctcagacaagctgcttcacctcttgggccttggttccctcctctgtcaaccccacctccacagcaaatggatgtggccatgctgtgtcactgcagcgaccgcacactctggagtttcctggctttcccccgtcccgccaactgtcccacagaccagcaaaacatcctgggaattccaggtctcaaagtccaagacaccttcccagctgcccctccactgttcactggtggcagaaaactcctcacttaggacagcttctagttcagccacctaaccagcccccatagcccactccctgcagcccattcatacccgcccctgggagaccttacaagcccagagcctcctgggccatctgtccttggttctaggcccccaggggcctcagttcctgttctctgctccatctggtcctcatcccctgggatcataaccaccccactccctgtggccagctctagccatgaaggcgagagatgtgatgccagcacccagctcaggcagcacacaggagtgctctgagatgctggctgggtgcgtgctgagggcaggcaggacagggtgggggcactgccacttggccttgaggtaatggggtttgtggcaggaaggccacccctgccagaggcagggtagcaaggcatggcagcgaggcatggcaggggccactctgagcccaaatgagggctgcccaggagccagcgcaggtagagaaggcgcattggataaggggagaaggcagactggggagactgcagggggccccgaatgccagtttgagggccgtggctgaggactctgtcctagggtcagggggcagacagccaatagcacaggggccgcagctcttcaggccacagctcctggattccttagactggcagggtcagccccaggccctctccctgaccttgcaatgggggatgacagtggctttgcgggaggggaaaaagccgccttccctgagcaccacctggatccccacgcagtgctgtgcccttcatgcccagacctcacttatgcaaggatggggcttggcagcccctttattcagcacatgaaggccctgagagggaaatggagcccaaggccacacagctggtgaggggagcccaggtgacactccagggccaccccatttcctgccctcagcactgctgagagcagctggggctgcaggaagtgtgtgagtgtgtgtgtgtgtgtgttggaggtggggggttgggatatccagaaccacctctagctcaggcccttccaccaggacccagctggccaggaaaccccccaccactgggattagcaggaccctggaagggaggcccttcctgtggttccattgctcactctaggcagtcctctggccagggaatggacaggctagggctggggaggggacagggactcacccaggcccagttttcacacagcttcagggacatccctggtctcactatgggaagactgagacccagaggggaaagagcttacccaggttcacacagcaaatcaggggccaaggccactccctctactcaccggaggtcagaaagctgcctgcgggatgttgtgtagctgggacttctcttgactgactcccagcacagccaagcctccagcatgggatcctgtggcatcaggattttcagtggctcctgagcccagactacagatggagccagccggtgccgtgggtgcaatggtttgaagacccaatttccccatcacccttcccgccccacctcacttcagcagagagcttggggtcgggggactcacggggaggctcgacgggctcacaatcctcggtgccacacagccgggagctcacaaggccaggcctcgtggccacactggtcactgtcttcctcgggtagccccgtctgggtgttgacacacttgaccagtgtgtgaccactggatgccaccaccacaggggcctgagcactggggggagcaggggaggaatgagtgtctccagggccagccctagcagtgggggcagggacacctcctctgggaagccgtccctgcgccctgtgcctgactggcctgcccttgctcccagccgccctctcagtgcctcctggaggacctgttcccattcctagagcccacttggtgctggaaccccactctcacttgtgggatcggctgctgcagagggaaggggcatgagaaccatgggacagcccttggggcggcagggcagtgagcccctcacacgggacatgactgagaggcctgggcaggggccccgggatggagccctgatgcagcagtgagcagagacgtgggcgagacaccgctgtgcccgagggacagggcagaggacctgccgcagcccatgggcaggaggggtggagacaatttcacagccggggcccagcccgccaggctttgttgttaacaggtgcaggtctgaaagccctaaacatgtgctgagtctgtgccagtgtcgtgctgtgcccggccctgtgctttgttgcgttcctccatttaatcctcctgaccctcctctcccaaagcgtcccaattttacagatgagaaaactgacccagcaaagcaaagcaacctgcccagagtcactcagcagccagtcggacagactcaaacgctggcccagctgactcccggacccagctcagggcccaaatctgagatttctgaacccctcagttccaaacaggcccagcagaaggtgtcctgcccatacgaggcccctcttctgcccccttctgccgctggcctttgctgggctccctgatctccccaagctcatcattcctgcctcagacttcacacctgctgtcccctcgatccctgtccttggcatcactgactcctccctcgggtctcaaccccagacccctcctcggaaggccttccctgacatcacagcacacatgccctttccttgtctgtttctccctgtcaggtgtgagcaccagcatggcagggctttgtccagtgactgctgcatgtgcaggggccacagacagcctggctcacagcacacactccacagctccttcacccaacccaggactgaccaggcgctaccaagcacttgctccctgctcccccccgcagcctggctcacctggccccagggccccaccacccactgtgtgcaggggtgggtgttgcagggccgggtggtgttgggtctcagtgcctcctcgcagaggtctggctctgggcaggtcaccagacgctgctgctcaccaccgccacaggcctcggagcactgggtgggcagggaaggagtcagggcacagccagggtctgagggtgtcccctccccccaactcaacgcccaggcctcacctccctccaggaagacatgtaccagctgaggcagggctgggccccgcagggccagtgcacaggcagcttggcaggtccaggctgacaatggaagggccacagtggccagagggcccatgtgtccacatgctgcatgtcccacactgaggaacctctgccacagctgtgggagcactggggaccgagagacttgtgtggacacatccccacgtgcaggcccacaggcgtgaccccgtgaggcgtgtggcaggaaaggcatcagacccacgccccagccgggggcaaatccctgaagagccccagcgagaggccaaggctggcaggccccaggcaaaaggtggcatggccaggggctgccatgggctgggacagacagagaaagggaggaacaagtccagatggggtcaaagatacagaggaaaggagacaggccaagccagacaaagatgagatgactcccaagagattcggaatccggtgcgatcaggcacatagacatgcagcctggagccctccccttccctgccgctctcggaacacaggccgtggggaaccagggctccaccccatgccctggggatgcctgtcctggctccatcctcatgcaccttactccagttgcctgagtgccaggtggcacagggccacaggtggcagcggcgggcaggctggggccggccagcggggtcgcagtcctcatcccggctggagctacagcacaccggcctccagagggcacccaggccacaggtggtggagcactgcggggcacagacccgtgaaagccaggcagagcccatcctcgccaggcctccacagccaggaaactacccacctaggctagcaagacctcagcaagacaggggccctcttctgggcctcagtttccttatttgcaaaataggctcctccacccacctcccaggaagaccatgagaatgaaaagtcaaatccccccagcaaccagccgtccctgctcacatgggacaaagggcctgtgtgccagtgtcattggtgcagaggttcgggggaggagaccctgtgggcacccctgaccagctatcctgaccagcctcgtcgcttcccagaggcaccagggaaggaaggctgggtcctggtaccagcagccaaatcgctgcctatccccgcgcaaaacaagccctgtgggcctcagcctgccccttcccaccccaaaattaggaatctgaacagaagcttgcttctcctgcagtgaccatctggggacccagggagggggcactagccagcttctttcatgcagctcagacgtctgcaggtcactgccaaaggagggtggagccactgagggcagagccaggtagcagtgggctgagtccagcctggaggagccagacagagcctcagggaagctgctgcctgctgggcaggactgggcctggtggccacacagggaccctccccactgcacagctgtctgagccagctccatcctggggcatgctgtgctgccagagtgtgcctgcccctgccttccctgaggccccctgtgctgcccaggaatgggccccaggtcccctcattcccctaatcctgggaacccccgccccaaggaaggcgagacagacggcgcctgcgtcccactctgctcattttcagatgaggaaatagtcaccaaggtcctgcgcaaactccctgcccgcccagcccacaccacttgcctcgctccagtttcccacttgtcagccggcgttcctgacaaccaacgggtccgtggggggccccgcttcagccaggctgggaggcagtggctgggtctcaggggctctgtggctgttggcggggctgtcccaagctggcatggacagcagcctagagctcaggggcacctcagggctgagggactcaggctgacccttgggtcctgggttcagggcaggctcaggcgtgtgcccgaggccagtcagggttgtggggaggaaggtcccccacactgccacagtctgcaggtcccatgagcctggtcctggggttgggaaggtggaagtccccggctgcaggggactgtccttgcccttcatctctggcaaaggggctatgggaggaggagggagagaagccaccctaacagtgggccacagttcactgtccacaggccccaggccaccctccagagctgactcccaggctactgtccctcctgtccacagctccgccacgtcaggactaggagaggagtgggtgctgctgaccgggtacaaagtgggcagcgtggggctgggtctcgggggcaggtggggtgctccgcagcccttgggtccctcatcatttgaaaacctcgttggtcctgtcctgccatggagagggcagctggctctggctgtccttgccaactgggaaatcattttggctctcaggggcggcaggcgtctgcaggccatcagtggaaaccctgggccagggcaggctggggagcccaagatctggggcccctatgggggtgtcttcctcaggcaggaaattgatcaaagggttcccaggggtctgctctgagggtgggggtggggagcggccggcctggctaggccaagggctcggggaccaaggtcccgttgccccttcctccttggctgcaggaggctctgtggcaggcacagggctacccgtggagggcgcagcaggacggctgtgtggtgggggcgtccgatcccctgtccccgccaggtctagatcaggctcctcagaaggcccgtaaggacagatcctcgtggaagctgatgaaattgtagtcgtagtagaagtcgtccacaaacacgggccccggcaggtccagctttggagcctcctcctcaatggcgttgcccatggtgcctggcttgggtgatgaggcgggtgaagggcgtggggccaggtggcgcgggatgaagtcagcctcgttgaagagctcgtggctggaggagccgctgcctgagccttcagggcccagtgtgtccaggggccaccaacagggtggcagagagcaggtgacttcgctggctggctgctgggcctcgtcacaggggacaccggtgtcactgatgcagaggacatttcggtgctgagtcccttcctcatatgtcactgagcactgcaggggaagccagggtgaggggcttagcctgggaggcaggctgccaggggacgctggggcaaggctgggtaacctgtccactgcctgatgtcagagtggcagagaccccagccagccctctctggcccttcccagctcaaggccatgactgtggccatgcttgccaggggcttcctgatccctgaggctttagagtcaggggctggaccctggaatgcccaggttccctcccacccacaaggtctccaggaaggctgtctgcctccctgtagctgaagaccaagggtggggctggaggcgggcaccttcccatcccacactcacctgagaccagttccccacagcctacgtggccggacagggcacatggtggttgcaaggggtttcagtagggggccggggaaggtgttcacaggcgggtggcttcagggcgctctgctcatccagccccacgctgcggatgcagagcacagcctggcaggagaggcccccaggcccgcaggagctggagcacagctgccactcacctgcccaccacctgctgagggcacacaggtgtcatcagtatggcatcagacaggtggcattgacaggctcaccagcagggagggccaggctgggtttccaggccctcggggtttgggcagtgccagaagccagtggatgattctccagagctccaagctcaggtaagtgtcctgccctcaaagtctggtgacaaggcacagcccctccactcctgccaccttcccctcagggaaactgagcatgacctgaggcctatttccacatccagggacccaaagaggaggaccataggtgtccaggctggcccaggctggggtgagaggtgaccgggggttggggcttcagccttgggaagagaatgaaagcccggctccctctgctcctccctggggcctctggggacccagatgtaggggcctgtggcagacccaggatgcctgggggtggggagttggtaggggatgggggcgggctcacctggcagggcagggctgctggctgcacttcctctggcagtcatcgggccggcccagggggtcacagtgctcctcgtccacgggccctgcctgccgctccgagcagtacacactctgcctctgcacacctaggggccatggcgttcagcctgggactggcacccaggtgcccaccgcccaagacccaaagacaccctctctgccagaaccctcccagaacagcgccttactgcccatgtcaggatgccttactgcccatgtcaggatgaaggcagacctccaccgtcgcctccttgctgtcctcctggttctcacccaccccctctcctatgtagcttcccctctgactgcccctggaggggtggcagagtgtggaggtttagtgggttgggtgcccagaccctctgcatcctagctgagatgcctgggcagctcatttggcctctctgaacctcagcgtcctcctctgtgaagtgggagcaacaatcctgcctcctccatgtcctggagggaggactgcatgtgttcttgcatgtgcaggctcagcccgtgcccggcacatcctaagagctcgatccatgccagctgctgctagcatgcaaacccagccgtggctcctgccaccttcccctcagggaaactgaatgtgacctgaggcctatttccacatccagggacccaaagaggaggaccataagtgtccagggtggcccaggctggagtgaggggtgaccggggtctggggcttcagccttgggaagagaatgaaagaccagctccctctgctccttcctgggattggcttgggtgatgaggcgggtgaagggcatggggccaggtggcgcaggatgaagtcagcctcactgaagagctcatggctagaggagccgctgcctgagccttcagggcccagtgtgtccagggaccactgacacacggtcccaccatccacacccttcccaatggatcagagaatgtctggacaagaaatggggcatcaatggacagcccctgctctccatccccacaccagccttggcactgctccagtcctttacattctctgccactgtccaacctggggactttgcacagccacgttcctcaccttggacactcacttccatactgcctgttgaggcccagctgcaggaccccgtctgctggtggctctgccttctctgctccaccccctgccccgtggtcccgagagtaagttgtccctcccctgagctgccagtcccacatccatccccctctttcctcaccaacagagtctgattttgttcaaggcagcagtgggacctgctgaaaacacaccccactgccgctcccttgcaactaggggggtctgggacacagtcctggctcaggagaaaaaggcacaagtccctcgctgggagtcagccctttcctctctccttcttgcctagaacactgcaagagccctggaagggaggacaccatctgtggcaagcaggagtggaggggaggctgctatggcaaggatggtgtggctgagggccagtcagctccaggtcccgccagcttggactgtgcacctgggacttcctgcctgagacaaagaacccctgtctcttccagccaccacagggcacttgcctctgcagacgctcctaagtggtccacctgcgaagcagccaatttgctgaaaggcaattccccaaatgtctagtgctgcaaatgtatttgttggttttcacgtttgtccaattaaagacacctgtattaggccaggcacagtggctcacgcctgtaatcccagcactatgggaggccaaggcgggcgaatcacctgaggtcagcagttcaagaccagcctggccaacatggtgaaaccccatctctaccactaataaaaaattagccaggcatggtggtgcgtgcctgtaaatcccagctactcgggaggctgaggaaggagaattgctggaacctgggaggcggaggctgcagtgagccaagatcgcgccactgcactccagcctgggcgacagagtgagactccatctcaaataaaataaaataaaacaaaataaaataaaataaagacagctgtattagataaaatgggtttcctagctttggaaggtaactgcccagttctccattttcactttgtcatcataatagcatttgaaggaatgctcaaacgtctgtatatcagattcccgattctgagaccctgaggatactgagtgtcaacgatgggaagactgagggggaaaggggaggactaagagacaaagggggagactgaggtgtggggagatcgaggaacagcagggcagaccgagcagggggaggaagaccaaggggcgtcgggggggactggggggctggggggagaccaaggaatggcgggggagaccgagccgggggaggaagactgaggggcgtggcgggggtactggagggccggagggaaactgagggatattggggggagaccgaggggtatgggggcagaccgaggggtatggggggagaccgaggggtatggggggagactgagaggcatggggggagactgaggagtatgggaggagacggaggggcagaggggagactgaggagcagtggggaggagacaaagagacagagaggggagactgaggagcatggggggagactgagggaaatatggggaggaagagtcggagttaatgaaattgccctacttttcataaatagttcagggaaataagtcagtgtggtgaggggcctgggctggtctccgggacgcagcagaaatgcaggcacaaaacctgccggagctgagcaaggacaaaatcaagggggagctgtgtccactggagggagaacgccaagagctgcagcacactgagcacacgccgcgagccagcacccacctgcctcatccatttaccctcccagtgggcctgggacatggggcggttgctagcctcatctcacagatggggaactgaggctcagagaagcaaacttctaaacccatggtggcccagcagtgagctgggagctgaagccggtgtccctgtccagagatgaagcccctgctggcggggctgtgcctgccccacttctcacctctgccacaggtgactgtacacttggtccagggcccacagtgccaggagaactcgggcggcgggacctcgccgtggccacctgcctccctgtggatggtgtactcgtagtgcaccccagggttgctctcctggaacagcagctgggtgggcaggcgggggcccgtgagcacgaggtgtcttctccatccacccagtcttaaaggagctgaccccagccacctctgtgaactgcagctacacagttgggccatcttaaagatggggaaaccgaggtagaggcctcagcaggagggtctggctcagagccaggctctgtgactaacccagggctcactcctccaggacgagacctaccatgggaggtgctgggcctggggactccgcctctgctccccacgcctgggcctcgggaggcaggcacctggatccagacaggctccttggtgggacccggggacgtgaggttctcccagttgcccctgcgtgcgtatgtgacggtggtccctgccacctggtagtccccgttctactggatggtccagccaccattgaggaagtacttctccgggtcctcgctctgcagtgccaggaagttggcagcctcagccacctcctggatgcggacctcacgtgtgctggctgggatcagccccacgtccacataccctgtcaggcaagggttgtgcctggggtgagaagcttgcttatccccacctgctcccctcacatctctccccacttgcctccgcctgctgatgccaaagatttcgccattagctttaaagtctgagctccccaaattgctcggatctgtcatgggtcaccaaaaccttgcggaggtgccacaaatcctgaccccgtggccatgccccgtcactcctctcttggggacctaaactggtctcatcataaggctggatccatcccctactctaagggccggctggcattctctttctaaaaaaaaccaaagtgcccaggcctttctcctgggacaccctcctcatccccacgcagcctgcttttattcattcacttccatcacacccatcacgtgccgggcactactctcagcacttcacatgtgtaagctcatgggtaatggccctatagcatggtactattgttaaccccattttacagatgagcaaagtgaggcagacagggagagtaacgtgcatgagcgtcctgctgcaatataagcagcctccagggccagtgctttatccaccacactgcactgcatctctgggatgaaatctaagcttctcagcctggcactcaaggccccatagctggccctgccttcccttcttgcctccagggctctggcgcaagctctttcctccatttggaatgcccattccatctcttctgagttttatgattcagctcaacttccgcctcctgcaggaaaccttccctgacttccccaggccaggaccttcttcttcagtgctcccacagccctctgggcctccctccactgcactgatcacaccagaaggttctgtcccccttcaggactgagcgcttcacctgcatgtcctcatcacctagcacacagtcagtacttcagcaacatgtgcaaaacagaccagaggtgagggcatggagctgggggtctcagaagattcaggaggagacgaccattctttgaaaggcccaggggccacacacaagtcggggtggccctgcctggggtctctgggacaggaagactccccatggggacaggtctctgcgtgtgggccaggggtcccctgactcctgcaagaatccaccccagcaagccctccctgcttagccatctctaggctgggtgggggccacgaggccaaggacaggggcccgggggagatggggaaggggccaccaggtgaagagcacacccctccccacagtggtcccaccccatacccaggccctcggcctcctcgaaggtcccactcacggtgtggcaggtggagccgttgccgtggcacacgccacagcggtcctccatagtgccagagtcaatctcaaagtcacagccccacgttctgcaacacacgaggaggggaggcccctggtgctggcggccagccctctgtggccccagccccgggggccagccagggtcaggagaagaaagctgggagtgggggtcgggaggcctctctctggccctgccccaccccagctgtgcctctgacccaggtgaacttctctacctccctgagcctcagtttcctcagatgtgagacagggagacccacccctcccttaaaggcatgtcatgagcatcacaagagacaagagaagggaagagttctgcaaagcctgcgggcaggcaggggatctgacacgccacgggctcctgagcagcgcgtgcagggaatttcaacgtcaaaggcactgggggttggcacctccctcctggtcctcctcggagcccaggccttgataccccagtggtttagagggcaagaagcaaggacaagtaggtggctggagacatgggtaaagaggagaggccatcgttgttattaaaaataagaatataaattgttaccaaacactgaggcctactcttcggggctcagagcccttcatgtcacctgtgccacctcatttaacccctctatcagggagcaaaccactgcctggggtcagccagccagcaagaggtcaagccactgcctggggtcagccagccagcaagaggtcaagccactgcctgggctccggtttcctggctggggcggtgctggtgcaggcatccaaggagacgcagtggggcgaggcctgactggggggggtccccagtgccaggaggcgtggtaggggctttgccttagaggtcatagagggtaggggctgggaagcccaatggtagagcatggggagggtggcccgaggaggaccaggagagaacctggggcccgccagtggggctgggggcaggcagtgctgggagagcctcttcctaaccaggcacaccttacagatgccattgatgcagaggtcccggctggctcggacctggtagcagggggtgccatcaaccacggcgtcccgcagcttcttggcaaagtactcattcgcgggccggcagtgcagctcacaggggttcactgggggcccaagtagaagagtcatcagcaacagctggagcgggagtatggaggccaccaggaagacccctccgtgacacacatccatggcaggctggaggctcccaagcagcacaaacatgctggaggctccggctgggctggtagctatctgcaaggctgcagattggggagctaggggcgagcagcagccccaggggacagtgggagtggcccaggcttggggtggagactgggtctcctgcttgcatcacagggtaaccttggacccacaccccgctcgccgccctctgagtctcaatgtttccatgggaggcagcactcaccgtcattgaccatgggcacccatgtgtgcagctggccctcgtagagcatagcgtcaaagtggctgcactggacgtggcggaaggaggggcggccagcggggcaggcctgcaggttgcagaggcggaagcgcttccgcttacccacacagtatctgcctttgtatctgggcctgtggggagaaccggggtggaccccagtgagggcccagtgagtgctactgcatggccacagcccagagcaagcagcttcctcctgcacccacaccccaagatccctgctgcccagctttgtgcacgctgcttccctcccttgggttgcccaccctgtggcccagacacaccctccctgtctgtagggacctgtggggaggtggcagcaggaagcctgagctctgcccccaacctgctgtgtgatcgtggacaagtcttcggccaccctctgggcctcagtttcctcatgtataaagtggggttggggctgcccctgcagagggctgttgagaagctgggacaagctgcaggcatgactggcactggctggagggactaatccgagtctccagcccatgacaccagcatcctaacgagcccttgagtcctcagccttcctcctggtggcagtacccccagcctgggtctaaaggaagcgcccagggccccagccagctgaaaggtatgatggagcacagctcctgaaatcctccacatttaggccagggtcgctggcctccactcagctcagacctggaggccaggaggcagggaggggcacaggccagtcttgggtaagcgcagggccctgggtggggccgactgtgaaccccatgcctgccccgggtggcctcctgaagtgaagatcagccgggtagtgcctcggtctacagtaccactggcctctgcttctcaccagatcttcacaccccctgcgcccccccatttagatggggaaacagagatccagagaggtgaagtcactcacctcaggccaccccttcagtgctgtcccatcctcccagctgctccatctcatctcaggcccttgttgtgcctctgaggccaccaagcccctcctgctgagtgcccactacagatgagctgcagggctgaggggctggcctgcataaactgcatttgcccctgactacaactttactggatgggcactgctattatacaggtggggaaacggaggcccagagaaggggtgaagaggggattcgaaccctgagccatctaaggtccagggcccatgctcttccccactgccctctcctgcctccttccagccagcagctgctttgccacgtggcctctgctgagtctctccagtctctgggcctcagtgtccccctttctgcaaaggggtcagcagtggggaccctgtcagccctcagaacactccttgaaagtgactcaaggtggcctggacactcagactgaccattatgaggacacttctaagagccaggggctggcacagagccaagctcctgcaatcggctgactgcctgggtccctctgtcccattgcccagggcaccctgggccccacactcacataggctgcatgcactgctgcttggctctctgtatgcccacgccacagctccgtgagcagatggaccaggcgctccagccagaccagccaccatccatggcctcgggctggaagcccacaggtatgcactccccattgagacaccactaccgagacagacggaggtagagccaccccacccccaagcctatcagtcatcctcaccctagtgagaacaaggtgtgtgagaatgctgcaaaaggcacagaggggaaggatggaaggtgagagaggccccctcgcaatcatcacaatcatctgtgacccaggccacatggaggcgctgagcagggagtaaaacagcccacgtgctgactcagctgaagacaccctggagaatcatggaatcaagccctggccccaatgcctccactttgcagacgggggcttgggctgcagagggcatggggctctctgtgagccggggctgactccagggcccggtcacagcaggaggtctggcctctcacacatccactgccgggactgggaacatcgcctaccttattctccccacaccggatgccgtccacggctgcatccagcttggagtgacaggtggtccccacagagcaccagagtgtgtggcagacattctgcgaggaggagggcatgggccatagcctcaccccctccccagtgccgccacccaccctgcccccctccctgtccccaagggtccctgggcacccctccacatggcaggggcccacagacccccagaggtcccttcttgtgtgtctgctcccaccttcctccccagaccacgtggtggtgtggggcgcccggggctgcactgctcagagtggtcctcagctgtccacacctctcccggcccagcgcctcctctggaaacactcctgttagaagatcacttcaggcgatcttcgccaggataaatagaccctccccacaggggttccttttccctcttatgagccagctccagagaggcgaagggacttgcccgaggggtcacagtcggtccatggttgacccagaattcagagctgggtctgtggccgcccatccctggcctctcccacaggccacttgacgtctcacagtgtcactcaggggcgtagcccagcccaggcgaggttgctcccaagctggcatccacaggctggtgaaagctgtcccctaagccctcctgtcgggtccccacacccccacacccacaccggccccactcacatccatgtcctcgcagaaggcagagtaggccccatactggaggtggcactggtggctcacatcatagaggaccccaggcagcactgatgggaagtcaatgatgtccttggcaggcgggtcatccaggcacaggctccacccatggctagagatgggacgggaggatggaggggggcgcagcctgtgagacccatcggagaagcctcggtggggccaggagaggaggagaggtgggagggggcacagagccctacaactgtaggaaactccagcctccccgctcggctcagccgatcctccacctgcagccagtagcacaggccctcccagccaatctcatctcacctcctgggcactccagctggctaaacaaccccaaccccaatcccaggcctctgcacacgctgccagggcccttccctcagaaggcctcctggaccgccaaaccctcatgtggccctgctctccgaccctgcagcctccgtgtctgagcccagaccctggagccaggcccgacaaggatccggagaatatcacatcacagttgacacaacagagcctccgacggccccacccaggcagagacctcgggtcatctgtggaagggcaaggtctggaaagcagcccctcccctgggagagagcctagggcatccgtgcctgtcccctgtttcccccactccccaacagggctggcctccagcctctgtcataccctatctactcctgccttcctccagctggcattccctggcagcggtggcggggaaactggcagacacgagcaggtgccatctgtgtccaccacacgctcctgctgctgcggtgtggcgaagacaaggctgcccagaccaccacgaggcagcgagcgtggagtccggggccctggggagggcggcccaggcccagctggcacctgcttctgcccctgcctcactctgtacagccctcaggcatgctactgcttctgggaccagtgaccagcctgctgtacctgctggaccttaggcggccactacaacggcttagcagcaggagtgccctggcatgctgaccagcccacccacagctcattgctgtcctggaggaaggtttggggccctctgtggggcagcagtggctggggagaattgagccatgcagacatgcggggctggggatgacccaggcagccacgacttgggcagaagcatggaaggaggcaggacccatgggacctggggcctctagccaggcaggggagatggggaggcaaaatccctccagttctccagtctgggtggactcagggtaggtggtgccaggccagatggctgggatgagcatacagtcctgattgggacaggcagggggtcgcacagggaagaagggcaaaggtgatggatcctggagtccagcagggagagaaagagacactccgagatgtggagaggctgggagaacacgaaagggtcaggaaacagggccaagagtgctgaagacaggtgtggagagaggctaggagggtggatcagaccatggaatcccgaagcccagatttcagaggagggggcctggcagctgggagacccagggtggggtgggtggtctgtgtggtctcctaagtcccctggccagtgacaggcccctgactctgcccagagctgcggagaagaaagccaaggtgaccagacttctactgagaaccctggaatcctcctggaatcactcagactgcccatcatggctggaaacagatcctctaacatgggcgttggcagatgagcagctgctggatgcagtcctagtgcccaagatgaccacgtgccagactggtccagggtgctgggggcataccctctcatttgctcctcacaacatcctgggcagactctaccatcatcttccctcatgcactcagggcccatacgtcacttgtcccgggtcgcgcaagagggacgtgatggccaggacctggagccaggcccaggctgcctgcaccaggctgtgtctactcactgggctacccccagtgcagggctcctcccattcaactgcgagcctggcctcaaatacttcaccccacatacaagttcaaaaccatggcagcgaggcctggcagggagaaaggagtgtcccaagttctcctgcggcttggggctccctgagcctccctgggcctgcacccggggcagagtgtcagccgggggtggtggggtcagctggccctgggctccctccttcccgccatcattccgtggctcgaggaggtagactgggggctcacccatcccagccagggggtcctctgacccaggggctgaggggtccaatgcgcctcatcccggcaccaacagtccctgggctgcagccgagcccttttgtttcctggctgccccagtgctgactcgctgcacatgtggctcctgcaggcctgctgctgggcagctgaagccgcaacaacctctcagcccaccctggatgttgggagaagttgggagcataaggtgaccctcacagaatccactgccagaatcaggcccaggtgctgtcttgggagtcagaaactcaaggtggccgtcagccagcccttccttcctctggcaggctgactgccaggttctctgcactgccgacacacccggatcccccaaaccatcagcccttcccctccacgcccctcctgaagctaactatagcagggctgggcagtcccacaagaggtcaaagcagacagtaggtgactccagtcagaagcttcactctcacctcaagactgcaaagagctgcccaccactgacaggagagacatgtgggcccgctcccctggccacccctgggatctggtcatggagtcactgcatggggtgtccatggggtgaagtgaaggaccccacatgttacctagcctgcctctctccctgtagaaatgctggctttgaggaaaccagggaccagggcctcccctcctccccacccaggtccaagttgacactggcgaaatgctgtgacctctccccaaggtcccataaagcacctgtcagcccagaaaggttcttagagttcttcaggtcaaccctcttggacaggccagtctaggttcttaaccaccaaacaaaactcttctctgcttccaatcccaccccccaccccagtaatccctcttccactggaggccagtatccttgctcttacatccctaatggacctggtcacatccctgcttaagccccacagtgagtggacttctagaaaaacatggcacattgagcagacagatttatcgctgcttccttccaagactccactataatgacagtagaggaaataaacaaggcataaatccataaggggtgatgatgagtaatgaaggatgtcaacaagattctggaagctgggaagcagatggccaggcagtagctgacttgctagagtgatgaaagctgagagtcagattcctgcaggggggaaccacccagaagcagaagcccgaaaaggctcaggaactgagtttgcagggactcctcagggccttacggccaggagggctgaagacagtagggctgaaagtctgtaagaaccgatcagaccctagatcccctccccaaccctgagtagccaagtgacggccacctgccacccagcagagggccagggatcactccctggggagggtgaaccaggaggctctggcccaggaacggtggacacacatgaaggcccaaggcagaaggacctacagagaaaaggggacaagcaaaagtctacacattgaagggtaagaaacacgccaagcccctttcccacttggatgctggaatgctgcagccagacatacactctcccaggaaaagtcgagaggattcctctcaggaaactgaatcactcagaaaaatgacctcagatagtgacattagaggatctccccaaaatagccccatctgaaccagtccttcagcagtgacttggaaaagtcctgcccaagtccacaaactgcccaattagtgtctctgcatctccttgctatatatgaaatacagccaatgcattttaagaaaacttttctttgagacagagtctctctcttttgcccaggctggagtacagtggcagaatcttggttcactgcagcctttccctcccgggttcaagcgattctcctgcctcagcctcctgagtagctgcaattacaggcatgagccaccatgcccagctaattttttgtattttttttagtagagacaggatttcaccatgttggtcaggctggtctcgaactcctgacctcaagagatctgcctgcctcggcctcccaaagtgctgggattacaggcgtgagccaccatgcctggccaagaaaactgttaacatgaaacaaatatatttttttaaataacccaaaggaaataaaaacatttcagggaacagaagaaaaaagtcaaatccgtgtaagtaataacctcacagagataagagaacacactgtacccacaaaacaggaataggatcaaaaggtgcacaggttgagtatctccaatcccaaaatccaaatgctccaaaatccaaaacttttgggcactaacatgatgctcagaggaaattctctttggagcacttcagattttggactttcagactggggattctgaactggtaagtataatggaaatactccaaaataataaaaaaaaaaaatccaaaatctaaaacacttctggtcccaagtatttcagatatgagacacgcaatgtgtatttagtgagtgagaaagttcaagaaattaaaagtacaatgaaaaaaatcaaaaatttaatagagggattgtaaagtagagtcagatacctcctagaaaatagagatggctaggcacggtggctaacgcttgtaatcccagaactatgggagactgagagaggattccaggagttcaagtccagcctaagcagcatggcaaaaccccatctctacagaaaaattaaaaaattagctgagtgtggtggcatacacctgtagtcccagctacttgggatgctgaggcaggaggatcatttgtgcctgggagctcgaggctgcagtgagccatgattgtggcactgcactccagcctgggcaacaaagcgagactcaaaaggaaggaaggaaggaaggaaggagggaaggaaggacggaaggaaggaaggaagggagggagggagggagggagggaggagggaaggagggagggagggagggagagaggaagggagtgaaagagagagaagggagagagggaggatagaaaagaaaagagaaagagatgaagaagtgtaaaatgtttaaaaataagaaagtgagagaatagctgaatattaagggttccagaaagagaaaatgtaagaaagttatcaaatcaataatacaccaacagttcaatcactgaagggcacaagtttctagattaaaacagtccaatgagtgctccctcaaattaaaatagaccaaggcatatatttaaaatttaaaatcaccaaaaagagagagagaaagagaaagagtcctaaaagcttccagattttttaaaaggtcacattcaaatccaaatggtatgggacctcttcagagcaatgttggaaactagaagacaacagaaaaatgccttcaacattctgaggaagagtcacttccaacccagaagttgatatcaaatcaaaatatcaatcagatgtgagggaagaataaagacactttgagacaggcaaaccatttacctccatgcgctctttctcagaaagctacttgaggatgtgctccaccaaaacaaattaaaaaaaaaaaaggtacctgcccataaaaaaaagtagcatgggatccgagaaacaggaccctccatgaatattttggggcaggcatagaaagcatccagtctaaactggaggacagagggaagttgggaggagggtccaggaaagaagggaacggctggattatctggtagagattacctttgggaaaactggattaagagacatcttataaaactgttaaaggatctggaaggcctggagaagcaatgaaaaccaagcaaataaaagcttgttcttacaaagaaatgccgtctagatggggcacagtggctcacgcctgtaatcctagcactttgggaggctaaggtggcgaatcacttgaggtcaggagtttgagaccaacctggccaacacagaaatcccgcctctactaaaaatacaaacatatgctgggcgtggtggcaggtgcctgtaatcccagctacttgggaggctgaggcatgagaatagcttgaacctgggaggtggaggctgcagtatgagccgagattgcaccactgtactccagccagggcaacagaatgagacactctcaaaataaaaaataaattaaaaaaaagaaatgccatcttattacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcgcaccacactggcccttcggcagctctagaaggccgtacctatctcctgactgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctattgctctgtaacaaactgagcagcttaaaataacaaacattatctcagtttctgtgggtcagtattctgtccagtttaccttgggttcactggcttggcctctcaccaggcagtgaaggtgttggtggtggctgtgatcatcccaaggcaggatagggagagaatctgtctccaagctcaggttggcaggattcatctcagaggctgctggactgggcctccgtttctagatggctattggtcagaggctttttacaataccttgtcacgtgggcctctccatagggcacctcatcacatggcaactggcttccatcagagggagcaatggaaagagcaggagaagggtgaccaaggcaggcatcgtagtctccttgtagcctcacctcagaagcgatgttacttttgctgtattctctttgttagaagtgagtcactaggtccaggggtggaattttacaagggtgtgaatggcaggaggtgagggtgatcagggccatttagaggctgcctaccagtgttgaagaaaattgttgacttctatgagctgtagcagcagacagtgctatgcaaggagaatggctgtctcagaagtccagctcctcacatgggtttaaacgtgttgccttttccccctgatacattttgtttaaatccatggtcatcttgccatttagtggtgtggtttaattgcatatttgggttagtctgtatgtaaacatttaacataggtgtctctgggttaaacaggaatcctattcatcttcttcaccgatatggtctgtggactctgatgagccaaatctgacatcagttctggaacgtctagaagatactaaggagaacagttcggtaaggaaagaaaccaagctattttctcttttcctcatgaacattatatttagaaattaaatgttaagtgataatattatataaaaacatgattaataactataatcttagaggaattaaagtctgggtattttaagtcctccaaatcttatttactacctggtttctctttattatttcccacatgtataatcttagtttagattagcaattcgggatctctttttccctgaattctaaccattaagccaagcaagcattttgggtggagaccactagccaaggtgggaagtagaaagaagaccaaggtggaagtgaagggagagatggggagaatgacaccagaactagtggaggggattgccttttttctttcagggtctgtaagtctgcagtaaaagtcaaaggtattcaaaataggaagttttgttttggccttagaatataaggagcataactttccattttgcaaaactttagaaatctttttttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggcctgtgaggatgaagctgtctgtgacagctaccacaaaggttactataggtggacaaatttcaaacaagtttatcaccactaccatccccaccataaaactgtctcaatcaagggcaacacaattcaatattagccaagacaacctctttacctgtcactgcttaagaaaaggatttttggtcttatttagaaataactttccgtacctatttttctccataaatccactgagaccaatgtgtggctctatcgcaagcaccagcaagcaaaactgcctgctagaaggttcagtttttgtatctttccaaatgtagaacacagctatcttcaaggatttcataattttttgaaaattgatgcacaaacttcttgaaagttcagagacacagcagctgtaattattctgaaggctggttacgggacacattaccttcatactttgctgtttaagaaatgtggggtggagaatcaagtaaactgatagaatttccatataaaattctaagtgctctgagaacaaaagaaacttaaaatacacacacacacacacacacacacacacacacacacggttttccctactaatcattttacaactaaacaaccaagttgctaaaccagagcccacaaaagcagagtcaaagttctaacacttggtaaaagaaaaatgcacacatacgcctgtgagctaaaaaaaaaatgcttaagtattcaaagacagcaattacagctactgagaacatcactgtaagcaaactgaggcagagaaaacaaacgtgctgatgaggatttgaaccacctaagctgcagaaacccactggatggtttcctaggttccgagttggcattatctttcagaacaatcttctagaagagatcacataacactgttacaaaggatctggagaaagggaccctggcttcatcactgtggctctccagtcatgctttacatttggcagtgactatctccattcaactcaattccctaaccctaaactagctgacatttatcaaatactgccctttaccaggtctaagtaagtttaactccccccacccccaccaaaaaaaaatcaagatactaagggatatactattcacaaaagggaaacctgtctcctcttcatatacctgttcctttcaaggaagggtataaaaatggggatgagggaggataaccactaggaatttgaccctatattataaattggtcagataaatgaaaataattcctctggactcaaagtgatatggctctgaaaacgggagaaacatcggggtcctttgtctcacgccagttaaacgacatggacacacaggagtggttttaaggaacagaaagtttaataggcaagaaagaagaaaggctccctgcggtacagaaaaaggggggtctgaacagagaaaaagccccgtgtgtggcagaacagtactcggttatattgggaggctggaggaggtggtgtctgatttgcacagggcccagggcattggtttgaccaggcaggtcattcatgtagcccgagaaaaacgtggccctcccaccctagccttttaatatgcaaatgtaggtcaccatgttgtcctgcacacatggggtcatctggaggtgtcaccttgaggtggtgactagaagaagagggtgggaatctccatgttgaatggacacagtttctaagcgctggcatttgcatatcaaagcttggcagcctgtagtcccagctactcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttttaatcatagtaaaaatgagaaaaatgcaagatgaagttaacagcattgctttatttcccatgaaaagctgttataaagcattctcaaaataaactgttattcagccacaaatgacaccatcacttttttattcatagggcacagtatcgctgccaaagagctttcctctatatgctctcttgcagggcaaaaaatattatctatgttatacagaaacacagtaaaaaaagtgatttacttaaggtcccaactactaaataaaagctaaactactcacttcctcctagattcagagagagctccaacattttctaaaatttggtatcttgttgttggggtaggcactttttggcaataatgaatagacatttaattagccaatcaaaaaaacttattaggtacagtaagttcctcttcaaaggtttaacctgttcaacttccttgttctttgttcctaagaacaatttccctgtaccttctcacccctatttacctgcttagttatctgctcagttacctgccttgtaaacaactcttcccgtcagtcccaacctgtaactcacattccctctcccttccttattagggagaatattcgcgatagcaaatcaagtctgcttagattgtgtagtccgactccagcccatgtggaaatgacagagaggtagggactgcgttagggatataaactcctgctctatcctgctcggtgtgctcttgcattcgtgactaatgcaaacagcagtcttttgcagaagtaagttgtcttgctgagaaaactttttttcctgagtgctggttcttccttgcagcactgatcatttgtttcttttttctttcttttttttttttttttttttttttttgagacagagtttcgctctgttgcccagggtggagcacagtggcttgatctcagctcactgcaagctccacctcccaggttcacgccattctcctgcctcagcctcctgagtagctgggactacaggcacccaccattgcgcccagctaatttttttgtgtttttttttttttttaggagagacggcatttcaccatgttagccaggatggtctcgatctcctgacttcatgatccgcccacctcggcctcccaaagtgctgggattacaggggcgagccactgtgcccagcctgatcatttgtttctaacaatctgggggctcgtctggaattcccattctcctctgagaaaagggtctccagtcaccaatagtgaggagaagcatcccactgcctcactgaggtggcctcatggtgagggatcaggacccacccagtgtgatgaataaacccggactctcagcagtctggaaaggaacagaccaacaacttaagagaaaaggatcctcacataccatggtgaccaggtaactatgtgcacagaccaacgtaagaaacatcacaagagcgacaaagtattttcttggtggttgggatatcttggagattgaaagtgtgtgttgagactcacaattgagtgcaaagcaagtgttcagtccagatctgcagttctgtggtcaccttatacagcttaaggtagcccttctgtaaaggagtctgggtcaggggtttctactgaaacagccattgctaagaggaaaccaacgttcccatgagggaagcagccagagaaggatgaagcgaaaggagaaaagtgcaagaaacctccagcaggggggtngagttttggaaaggaaagggaaaggaaagggaaagggaaagggaaaggaaaggaaagggaaaggaaaggtaaaggaaaggaaagggaaaggaaaggaaagggaaagggaagggaaagggaagggaaagagaagggaaagggaagggaaggtaaggtaagggaagggaagggaagggaaggaaaagaaaggtgagaaatctccagtaggagaggttgagccttatacaaacctctcgtaactgggaagaaatttctagtaggggaaattgagcctcaccccaatcccttttcaagatgggaaatacctcaagtaatgcaggggagaaaaaggataaagctagcaacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggatttctccctccaacaggtggttttctgaggatctgcttattagtcttcttacatactaggcaactatctgtaacttgtcttgccaaaatataaattcctatacatctgtagaccccgaggactgcatcacacttagcttgaggtccctaatgagtcccttgatgcagatgggagagaatttccctcatgaggggtttggataacatttctctttggtctggtgacacccatttcccttctgaattttctttggctcctatttttattaatttttccttttcagcgggagaaaagatggggactgcagtcgagggaggaaggcaaggggctaagtgaaaaacaggcattttcagaggaaacggcagtgtgtttggctatttgatctgctaggttattccttccgctttgaaaagaaagacttttctaatgtcctggaacatggacaatagctattctggcagctgcaggttatctaatacttgggtgattaattctttgtggcccaggtcttggcctttgctattaataagatctcgttcagtccaaatttttccaaaggtgtgagctaccccaaaggcatacttggaatcagtataaatagtccgttcttggttttgcaagtgctttaaggcttgatttaatgcaaacaattcattcacatgtttgggcagaccaattatttggcaggcttcctgactctacttcttcaagtgcctccccatctactactgagtacctattacgcctttttccttcaattacttgggaagagccatctataaagaagccctgccccgttttgtaaggggtctctcttaaatcaggcctaacttttgtatgatcattaaatctaaacactcatgctcaggtctctttagatttggatctccagtcaggaaacctctgggttaagtgaattatcagtggttagtgttaaatcatctctttctaacaggatagcttcatactttaaaattctcaagtcagtaagccatcttcctgccttttaatttaagatggctctaacctgatggggcatgtttacaactaactttcccccaaaggttagttttctgctttctttagttaacaaggcggtagctgcaatggattgaaacattcaggccatccacaggttactggatctaaaacttttgataggagatccatgggttgctggtgacctccgtgttcttgggtaaggacccctaaagctacccccttatttatgttaacagaaaggtgaaatggcttttctagggaaggcaaagctaaaacagaggcagttataagcagatgttttagctcctcaacctggtggagttcttcagaagtccagaggagagggtcaggcttttcttgggtgatttttaggtagagaggctttatgacaagggcatatgagtcaatccataagcggcaatatccagctatccctaggaattttctgagttcttgtttagtcttaagcaaaggtatggatacaatcctttcaaccctctcaggccctatccttcgtttgccgttacttattaagtgtcctaggtatttaacttcaggctctatgaatcgaagctttctctttgaaacccatagcccctctccttacaaatggttaaggatatggacggagaaagcagataccttttctatagcctaaccggatattaataagtcatctacgtactggagcagacatatacattttggggtataaacttgttctaacacttgttctagaatttgaccaaagagattaggggaatctgtgaagccctggggtagaactgtctatcgatactgttgctgtcatccagaatggggatcttcccattcgaaagcaaaaatgtctcagctgtcctcatccaaggagcatgctcaaaaggcatcttttaaacctattactgtaaaccattgatgttcatatggaattttactgagaatggtttaaggattagggacaacaggatgggtagtctagactgtctggttgatggcccagaggtcttatgctagtcgacatgacctatctggtttcttcacaggcagtattggggtgttataaggggacatacagggttcaaggagcccatccttgatgaggctttcaattacaggtttcaggcctattctgccttctaaaggaataggatattgctttcttcttactatttctccaggggtttttaactttatatgtatagggggaatttggagttttccccaatttccttcccttgcccaaacatcaggatgaatgtatgtttcttctgcagtggtgagcaggtttaatgaagtgtagaatccttctgagccaatacgtaaacctatacctaattttaacattaagtttcttcctaatagattagttcctgcctctgaaattaacaaaaattcaacattagctgagcagtttttacatctaatttctgtttcttttaaaatttttagtttgattccctctccttttacccctgagactacaagctcctctgaggaccaggttatattgtgggggaaggtaacaaacagaggagcaggctgctcctgagtctactaaaaaggtcataagctcggatttgggttccacttctaaatttatcaagggctcttggtgggattcaaggtaaaagagacagagcccctaacccccctattcctcctcaaaggtcgtaagtgggacgacttctctttctgattttaatttgggacaatacctcttgaagtggcctactttctcacaattgaagcattgattctgtctcttctctctatttttgggtttctcggctttgtctccttatgttctttatatggcttaggaagtgggggcctaggatctttataggttttggctctcgggaggctttgtttgggagtgtgtgggtctctgggtaacagagagtaatactggtgtgttttatcctttggggccccctgttggaaggtggataacataattttcattttttctttttgcttctcctcatccctccttacacacactttctgagcttctctaagaagctcgttcgtgggatggtccttccaatttcctatcttttgtaatttccttgtgatatctggctgttagtaacaaaatgaagctttaacattcactgcctaagaggatcttctaaatctaggccagcatattttctcatttgttctttcaacctgtctaaaagttcgataggcccttcatctttcctttgttgtatgtcgaatgctcgagtaagattttgggttcggagtactgactcccgaatcccttttattatcatttccctaagttcttgcgtatcctcttcagtgggctgcgttattattgtcccagcaggggtcttggttggggaatttttgatccgctgcatgaatgttttggccaggagggtgttcatgttcccagggtaccatagcagctctacagatgatgcttctttcttcccctgagaaaaggatgcctaggatggacattaactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcggctcatactgcagcctccacctcccaggttcaagctattctcatgcctcagcctcccaagtagctgggattacaggcacctgccaccacgcccagcatatgtttgtatttttagtagaggcgggatttctgtgttggccaggttggtctcaaactcctgacctcaagtgattcgccaccttagcctcccaaagtgctaggattacaggcgtgagccactgtgccccatctagacggcatttctttgtaagaacaagcttttatttgcttggttttcattgcttctccaggccttccagatcctttaacagttttataagatgtctcttaatccagttttcccaaaggtaatctctaccagataatccagccattcccttctttcctggaccctcctcccaacttccctctgtcctccagtttagactggatgctttctatgcctgccccaaaatattcatggagggtcctgtttctcggatcccatgctacttttttttatggggaggtaccttttttttttttaatttgttttggtggagcacatcctcaagtagctttctgagaaagagcgcatggaggtaaatggtttgcctgtctcaaagtgtctttattcttccctcacatctgattgatattttgatttgatatcaacttctgggttggaagtgactcttcctcagaatgttgaaggcatttttctgttgtcttctagtttccaacattgctctgaagaggtcccataccatttggatttgaatgtgaccttttaaaaaatctggaagcttttaggactctttctctttctctctctctttttggtgattttaaattttaaatatatgccttggtctattttaatttgagggagcactcattggactgttttaatctagaaacttgtgcccttcagtgattgaactgttggtgtattattgatttgataactttcttacattttctctttctggaacccttaatattcagctattctctcactttcttatttttaaacattttacacttcttcatctctttctcttttcttttctatcctccctctctcccttctctctctttcactcccttcctctctccctccctccctccctccttacatactcacaccctccctccctccctcccttccttccttccttcgacttctccagctcctttacttgctgctccaactgcagtgtgctcttgttctcgttgttctggacagaaagaagcaatcagtggccacccactaaaactggagaccccagaacttattgtctgcctcccatggcaccgggaagggtggaggcaggttagaaaaatatcccctctctcccacagccatcagagcagggctctggctcacagatgcctttagaagtaccatttcatgtgaaggctacaatgccccattttacaggtggggaaacaaaggccttgagggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagcctctcctcctgttcatgtagcctctcctcctgttcatgtagcctctcctcctgtacacgtagcctctcctcctgttcacgtagcctctcctcctgttcacgtagcctctcctcctgttcacacagcctctcctcctgttcacgtagcctctcctcctgttcacacagcctctcctcctgttcatgtcgcctctcctcctgttcatgtagcctctcctcctgttcacgtagcctctcctcctgtctcctgttcaggagactcaacatctgattgttttccacctcagcctggagctgtcttcccacactctctagctccttccttaggtggttggtctcatcttgtagctgctccacctttgatggccctgctgggggctctggggccaggggttcagctgagaaagcaagcagagaataagggcctctggattctcaaaaaaaaaaaaaaaaaatcctccctttggtgcacagctcctcctctcaggcttcccaaacttggcctcactgctaatgactcctcacacccggatggtagacaatcttccaagtcactttcagatagagagcactgtgggtggctgacaatgggcactcctccctctttactgatggggacactgaggctcatggagatgacaagacttgtcctcccctggcacagacctctttccctctgcctcaaagcccttccatccacccacctccctggggcattctaagtcacccccacagccctctaatgccagtccagctgccaggtcatgccagccccatcttacccgtctggtttttgagtttgaacaagctcctcccaagcttctgtaccagatgtatctcatgcttcttctcctccttagatgtgcgaacctgcccaaagcaaagggggaaaagggccctggagggaggggctggtgaacgtccagagacagagtttgagaaaggcccaccccccttctgccagtttgtgatttagaaacgtgcattcattcaacaaacatttactgagcatgtacaggccaggtacagttcttcatagcagagatataaaacagcaaaggacagacaggagcccttggccctgaggtttccattctaggggcctttaaatctctgactttcagagctaaccaagacctttgatactctctacctcctccagaaacacgagcataaagaggagagatggcttgtccagactcaaaaagcaaattagggactgaggcagggcagaaatatggacccctgacaaccagtcaggctagtgcttcccagagaggtgacaaccccagggcatgtgtggcaaggactagagcaggggtgtctggagaagagagagtcagcaaagagggcagtgcagaagacccatgctgcatgttctgtgctctggggtccctccaggtgagacctgggtgcccagctccccatttgcccttggcatcaggggcccctagctcctttcttcagggccccaagaggaaactggagtccaggattgaccagctgtaatcaggggaccccactggactcttaccagtgaattgatgttttcagtgagttgactgattattgcggagcttgaatccagggccactgctagttcttggtactggctctgaggtgcatgcagagagaaggagttggaggaagattgtggcgaggggtagagagaataatcattagggctggtgggggtgtgtgggctgcctcagctggcagaggggcaacaagcccctgctgtgggaggaggttggagggctggcctgcagggtcactgcacctcggcccagggcctcttacctccagatcctgcagggtagtagaggatgcacggccctccccgtagatacctgttgctgactgcaagagatgagagtgcacatggagatgttctgtcccccctcactgtctaagccctctgacttcctttcttcccccatcaactggcaaaagcttcttttctgcctatcttggacccttttccccataactcctttgtgccaacttctctcgtggttcttatctccccaccatcccaccctggggccctttcagtgactcctaaagggacagcctgatggcaagtggctcttctcattggcctggcttccccttgagactggggatgaggaaaatcaaacagcaacgaccatttcctcagtgtcctgggtgtttgcagcaggccatgtactaaggattcacataaaagcaacaataacgaatctcatttaaacttcacaaatggaagtcaaaaaataccacctctattatacagatgtgaaaagagaggcccaaagacctcaagcaacttgccctaaatcatatgctaatcaatccctaatcaattcttagcagacggagaggcaggattcaaatccagaattcttaaccagtacccaacagtccatctacaatcttaacaattaccctctactgccccttgggccccctgtccccaggagcctggcccgccgagactcacatccccaggtgagtggtaaccaccagaagtggctgtgtcagggctactgccattgactttctttttcctgttagctcctgctggaatgccagggctcttcctctgccaatatgcttttaactgtgggaaagaagagcagtaacactcatgagaatgatcagcccctacagccacatcctcctttacagttttgacaaaatacccttatataccatctgatgtaatgccaccaacaactgtacaaggtgttgtcacaatcagtgactgagagggattcatatcatggatagaaaaaaaaaaaaaagaaagatcaaaaaaggcaatactggaacttaaactcagtcctctgactccacgctctggggttttgccatgaatcagcagcttccagggaccaaaaccaggggcagaggtagaaaagcacacattaagcaggcaggaactgtaggccgtgtggtttagagtcatacatcctcacaggtctgctagcgtgaagaagcgtaccagtacctctcacactttcatatcaatgtgtcctcatggcagaaggcagcttttctattaaatctgggaatttatcagaaagaggacaacccaagcctcatttcagagcgaagtctggtatacgcttggaaacctatgtgtctgtcatccccaagtacattaatgcattttctcaagagaatcaagggaaaatgatgcttcagaaagatgtcccgcatttatcctgtggcactcaaagtaccccaggttgagacgatatgacgactatcaagctgtcaagttcagtttccccagatctattccacagaagatgagcaaatctcacttcagagnccactgactgaanggcagtctggtcccagaaccgtggagactcagaaaaaatgttaaagtctctctggaagtagaaagcctggaaaaaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttcggatatctcgcctgtgggaattccagtcaggatgtgcgggggccactcaggtgcccagtgtgcgccctggcgatgtccagcgagaagcagaggcgcctgccggccttcccctaggcctaggccgagggggactccccagctaggatcttgcagatcacgctctgtgacggccaagacagcatacgcccactctgtgtacaggcctgggagctgtcagagggcatttcgctctttcccagcttcgggatactggactgcgaagcgggaaaatcccgtgacctcccacgttcacttcgacgttagggggaatgcttccgtacccgccgggctacagtacgccgcttttcacaccgctggggtgagagtgcgtgtctttacacatttcctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatcattgcattccactcctcccaggggaggggaccacatcagcgcgatgcccgagtcgctgctccacgatgggggagggaaacacacggtttcgacccaggtcctcagagacgccagcccaagaagcctagggaggtcgagcttggggcagcaggaggggagggcagagtctgcagtagggagccccgggagtcaccagcccaaagccacccagggatgactggtgagggcagggcctggggctgggggacccaggtcctgggagacgcaagcccaaagagcccagggaggttgggcttggggtggcaggaggtgagagctgattatggagcagggagccccaggagtcacctgcccaaagtcaccctggggtgattggcaagggcagggactgggctgcttgctgaaggggtggggctgactgactaggctttggttgggggagcccagaggggctggggttggggggccccatctggtatgcctcaggagtggtatggactctggcacaggtcttgtcatcggaggggatctgtggctgggttgggggccatgacctggtgtgttttacctttttcttggctgcggccaatttcccctgctgtgttttttctgacatcgcggggtggggagggaggcggggttggggccacatcagcgaaataccagtgagcactgctcaatgcctccagtcacctaccaggcagctgtgcaactgagccacaggtggcgtaaccagggcaccaatggaacgcagaataggggcgtggccttaatgctccaagcccattggtcagtgagaaagatgaaagggaaaggaggcgtggccaggcagcagcatgtccagagggacctgtggcatcataaggaaagctgcccatgcaaccgctgtccccgcccactcagagaaaggggaggggccgcccactctgggagaggggaagggctgggttttgctttaaaacttttaaaactgtaaaaaataaactttaaaaaatatatgtgtatatactttatatatatgtgtgtctgtgtgtgtgtatctatgtgttcctccagagctgtcttcattatgcagcttctgtgcaaagtctgtgattttggcctatatttttcatcttcaaatggagtacaagaattaccagtattaccttaactgagatatagatcctataaaaatggaaaatccatagcatgcttgatgattaatgaagccgactatagtatccgacattccaataagacaaaataatcacaacaatttctcttttttggaaaaatgtttgtcttattctcctacattattgttaagatttcttttaaaaacaagaaacatgtctaatatctttaaaaacacaaagcttttgggccgggtgcggtggctcacgcctgtaatgccatcactttgggaggccgaggtgggtggattgcctgaggtcaggagttcgagaccagcctggccaacatgatgaaaccctgtctctactaaaaatacaaaaactagccaggcgtggttgcgggtgcctgtaatcccagctatttgggaggctgaggcaggagaatcacttgaacccaggagatggaggttgcagtgagccaagctcacgccactgcactccagcctgggcgacagagcaagactccatctcaaaagaaataaaataaaatacaaaataagtaagaacacaaagctttcaatttaataaccacttaaagctctttactggtttaagagaattacaaggcccatttttctagaatcacctggcctctctaagccttgcaaatgaagctgaatttctcacttgatacttggctctcacttgcagtcatgaaaaccaagaatttgttatgtcactgtgtattgcttgttacctgaaatccacactaggctgggatcaagggttgaatctttcatgattttctccataacctgtgtgcttcttatcccacaccaaactaagctttttttctagagctctgcaatttacagttagtatatgagagcagttctcaaaaatgtagtctctggactagcagctccagcagcacctgggaacttcttataaatacacatcctccggccccaccctggacctggtgaatcagaaactctggagtagggctcagcaatctgtgctgcagtaatccctccaggtgttcaagaacctctggcatacagcaggtagaaaaatgtgtttccttctgtaggtccaaaaccagggatactatatgttttctctatatgaaacaatgacgtgcaattaaaagacataaatctccttcctgctcccaccttccagccaatgtgttttatttttatgagttaaataagaaaacaatcagagatttcgtctaaatcgcatatttacaggtatcagttctcatccagcctgatcttatccaatatcatttatattctcttacatgtgaagttttagagaaggatcttcacaatgtaagactcaggcacactagcagttctgtaataaaacaccaagtagatcagaatgtccaaacttactggagaagaaaagtggaatcattggctatattttcaaattgcaataaacaggatattaaagttttgaatttttttcaccttcatccttccacgttaatagaattaagccaaaatacttgtcttccaaagcctctagccaggcaaaattttactatattacttcttgcttttcaatggctataaagcagactcctggtaggcacatttggtatacctgcaaagatgaagaactaaacagttccatctgttcaatactgaaacaaaagtcctgcaaacctcggatggtgagtgtaatacttcagcactagcaccaaagcctcaaatatgaaaagataccaagaacaccactagcaaacaaaactaaactctcggctgggagctctagttcatgccgtaatcccagcactttggcaagcaaaggtgggaggattacttgaagtcaggaattcaagaccagccttggcagcatagtgaattcacacctctacagaaagtttttaaaattagctgggtgtggcagcacacttcctggggcagatgtgccattgctggaaacttctctatggagagtaccaagtacttctacctgtagcattttccctggctggaatcctgcaattatcacagtagcccgagatccaagaaggcagagcaggagcatcctgtcccctccccagcaggtgcaagggaggctggggggtgaggcacaagcccgtgggagggtgaggagcaggagggatgcatggtgagcctctgttgactgcttgctgcctcagctggaaggtcaggaccaaatgtctattacaggttaaattacagaagtatttcagattttggatttttttcagattttggaattcgaaaatctgaaatccaaaatgctccaatgagcatttcctttgaatctggccttcgaacatcatgtcggcactcaaacagttttggattttgaagcatttcagattttggattttcggatgagggatgctgtattatcttctgaatgaggccactcattcaggaaagcccagagcttggggacgtggagctgcagaccaaagaggtgatttctgtagtggctttcagtgcggaagggcctacaaagtggtttaaagcaagccacaaaataggaaacccaatatttagctaatggaactctgataaaacctgctcaagatgtctgtctctactaattcagatggagccaagccaaagcatcattattattttaaaaaggcaccaatccctctgcaaaagcactgaattatatcatgatacaatcatcaattgtaccatgaatcaccatcagcggtggtcttttagggatatgaagaaggggttttcacaatacatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgtgagaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaactgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgcactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaagaaggaaaattttgagggtttttgcttttttcaacttcacataccggtttgcctttgcaaaaaaaaaaaaaaaaaagtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccgggggctcccccgcggggccgagcccgagacagctcctcacctttcgccgcggaaaaaaagacaataggctgcctctccccccggcggcggcagcatcggctgcggctaaagcggcgggcaaccgaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatcctacacaattcatttacttcatttgaatgttagagccacttatgtttatttgtgtttctaatttatagtttaaatttatttgtgtttctaatttataatttaaatttatttgtgtttctaatttatagtttaaatttatttgtgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctcaagtgcgcggtctattactttgtaatatgccactgtgagtactgacatttacagttgtttaaaggtggagcactggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctgggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaatgtttacaaactgcagcgcaatctactgtttgtgactgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacacttactttaactccattttaaaccctcaggctagaaatcgtaccactgttaattagccacgttatttggtctaacagtttttgtttatcattctgaaactgagcttatctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactcaagtctttcttcaaagtgcatgcagtctcttgcagtacctcattcagccaagtatttgttctcttcctcattcagtataaggcagctttcaatttgcttagaaggcaatattagaaggttagagttcagcagaaagagagaattttaaaatgtgagttcgactgaataaatttgaatttctgtaggaagtaaagaatcaaaatacctatttaaagactgcaatatatgataattatttttaaagtaatagattaaacctgataggttttcctgaaatgaaaaacaatcagttctaaaaccaaagctgatttttagaaaatgtgaaaatgtaaatcaaccctatccaaaatagattctctaaaactttatcttacagtcactttcaaataactattcaaaaatgtaactgttaaattaatgtcttaaaataatttaaaacattttaaaatacgaatactgtagcttaaaacaaagaatctaggggaaggaaaagtagagaaagaaatgccaattccagtccaaagctgtatttgccaagttttcttagaacaacttttaccgatttatgaattcttatacacagaatgcatgatggaaatactgatttttgtctaaagtggcattattgactgcttctgtgatgctactgtaatgtaataaattattagattatttcaaggtgctgttttgcctaaaaattttgtgtgtcttgaaaactatagtattaaaggtattgagactgtgcaaatgctgggcatgcttggcatgagataatcggtttttattcttacaaaattgtaaccatataagtgtgtttattaaaagaacacaaactaaaaaattacaggaattaaagttgtgggatgaaaaagttacgggataaaaaatactgtggaaaagttgtggcaaaaaaagatgtgggaaaaaagtaaaaaaaaaaagttttatgaaaagtttttttttaaagttctgaaaaagaagttacgggatttaaaaaaacatcatgggataaaaataaaaataaataaaagcaggcccctgtcagcataagcctggagaagtgggtctggagtcttcacccccaccatgtccctacaacccctccccagtcagccctttaccattagggtagcaagacaagacccctgtctaatggagggagacaaacagaccctttaccaccttgaccaaggctgagtccttacatttctggatgatgatgtttgttatttaagagccagaggttggtggagttggtttgtttggaggaggtctgacggcctccttactctcaccaaagcaacttttccctcaagggggctcccatcttcttactcagagaggcagctgaggcgggacagtggagttaactgtagacgaggcgagggcacaggctgctgggggtggccccccttcccccgtgtacatactgtagctgtgtaacattctgtattgtacctagcggaggttgcagctggcatatgaggaagaggttcttataattattcacggctgggaaacttattcattgttagcataggagcgatgatgggggtggggatggcgtcatggctccctggtgatgggaccccttttttgttttgttttgtttttttgtttttgttttggttcgcttttgattttggaataaatggatttagccatactgctcggcctggcatgttcctgtttccctcactgggtcctgcagtttttcccactcaatgaggagccccagagtgtctcagcatgtccagctgggctgtggggaatcttccaggcctgttacctgtatgctgcctggtgatacctggtggatttcacgaggactgccatggcgcctctggagtatagtccggccctgagagccaacaggttgagaagcctgatctagctgtggtcaggaagacagataccagtgcccaagggcactgacttccatccaccccacgtgtcttccattccgtccccctgcctccctctcctgtctgcaccgggtggcctgtctgtccctccagagtgccggctgccccacaggctccttccaggctgagttcagggccctgtgccctactggccagagccggcttcacagaataagagccagctaagctccagggactttccaggaaaagtgtcccttgaaaagggtgtgaccttttcactgctgccaacagcaccctaaaaatggcttggcctcttccctcccctgagctccatagagaacacagccagcagaggacacattctctgtcattcagaaatgggtttctcagccgagggacagcaggactggtagagactgtcaggccacacagctgcctgcacagcaccgccatgcttggccagaagggcgggagggatggcgggggctggctgtccataggccgcgcatgtcccggaagctcactggaggtggtgcactttggaggggcgatgtcaggagacagcttcctcttgctgggctacaagactccacaagcacagcacggggactgattcccagtgctagaggcgaggcagtcgaccacatgtatatgtgtatatatatatatgtgtgtgtgtgtgtgagtttgtgtatgtgtatatatatgataatttatagctatttatagaacagggcaggggcataccacagagggggcacaagttttcagcaacagtcacacctggatgtgtcagctcaccactacaacagactaagtcacagaagaagggggctggctttggggctgggggagccactgtcaagtcacaggacacccacccaggcaggcttggaaagggaggtctctgagaagaggaggaatctgtttagaggtcgaagtggggcctggggctccccggatgggatggacttgcctgacccaatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggaggaagatggagggagaagccggagcttcataggtagtgcctggggactgcggcggccctccccaccccacacacgctggcctctttcatggcacccaggcagtccacccatagttcagacgaatgctcagccccctcgggcttctctcttctctggtcaccctgtcttccaactcacggcccagggccacctcttgcttggggagccccacccaacagccaccaggcctgatagaaagggaacactgcttgaaccaaaaatggtgaagctataagggatggatgactggagtgagtgccagaggcccctctgggtggtccaaaatcccagggtcctctgaagggaccctggggaaggcagggagggcaggtagctggatgccactggccatagacttataagtctaagaggggagcctcaactggttggcgggcgtggggctgcaggttgcataggtgaggctgggcccttcctgctgggaaaagcagaagagggagagtccatggcaggagaggcaggtgggctcgctaggcggagctcagctgggccagcaggcactgtggtccccttggctgaatagcacaggcgacccctaggagcaacaggccaaggtgtgtgagcctgctggtcggcgatagtgattcagcgggggccagggaccctgccttcggtcacacactagcagctatggtggtacctgggagggagggaagggggctgtgtgtccccgcctggcctgtggagtgtggagtgtgttgtgggatgaccgtgtgtatgggactctcacctagataccactggattgccgacagatagatgaggtggggccctgactatcagccctgctttgcagtggatttggctctcagcactcccaggctgggagctggatacctgccctggcagcatgactgagactgcacgacaggtatggcatgcccaggatgatgttcctagggactggttcagtgtgtgggtcaggagcaagtcgacaggccctgctccttaccccttggaagggactgccaccaggggcagttctgactaaggcctgggaacccatgactcagagcgtgggtccccaggtcttgctgggccagcctggctgctgcagacagacaggaagcacgtctgacgctcctccaccctcggtcagcacagcggggctgggactcacgctagccttcccagcaacttgctttcctgcgtgaactctggcaggctgccctctctgtgcaaagccatagctggggcctgcttggggccctctccctctttcacctgctcagagtggcctggaacttggaggtgggcagtcggcgcctaggatgggcctgtgtcactagggcatgtgtccttgggccagttacttcctcttagggccttgggctcctcctctgagaatggggcgtgttggtgtgaaatgaggtgagcatgttgatttgaggagcagcaggacagacacctgcaggcagcccccctggccacattcccctccctcccttccaagtcctgggacagacgctcttcaccaaggggttcagcctctgatgctctttcttggtctcagtccctaaggagtaattttttttcttttcttttcttttctttgagacacagtctcctccctctgtcgcctaggctggagtgcaaaggcgtgatctcagttcactgcaacctctgcctcccaggttcaagcgattcttcttcctcagcctcccaagtagctgggattacaggtgcccaccactgcacccggctaatttttgtatttttagtagagatggggtttcaccacattggccaggctggtttcaaactcctgaccttaggtgatccgcccacctcagcctcccaaagtgctgggattacaggtgtgagccaccgcgcccagccaggagtgattttcagtggtgtcctctccatccccagcatacacccagccctgagtggccgcggctgccacatgcaggctccagggctacatttgcctttcgtccagggttgtcatacgctggagagtagaatgtgagaggtgacccctgtaggctgcagggtggcccctctgaaccttagtgtcccccacctgtagaaggggcgtaacaccttccagggggagggctgaggaggaaattgtcaacggctgagtctaaggctcacagccagaggccaggatcggatccagggctgggcctgggcctgggaggacagtgtccgccccttctccagcctcccgcccctggtcaggccaggaccctcttcaaagcaccttcatgcccatctgttccctgctgtgggcactactgtctggctccatgggactagattttatgggaggggaaggggctgtgggtaggcaggtgccaggtgctggaccatagatcagcatggtaggaacctgttgcttgggctggtggtgggaaaggggccaacccaaggcagtggcaattagcccagccctatctctgggcacagagatgaagggacacgtggggacacagtagggcaaaattggccagcctgctcttcccctctctgcccgctttttgcagaagagtcaacagatagaacagacagagccagggaggtgcccatgggggccccagtccccaccactccagggggcagtccctgcaagtgacaaggtgggctcaatccctgtggaacaggtctctgaggaccacagagtggggccccagggaaggctgggagcctgagctgaaggcaggcagcaagtaagggccaagctgtgcccctgcccagaagaccttcctgcccccagaaccccaccctctgcagacaggcctccctgggcagcagccccccggcttccgaggccttccgtgcctcaccagatgccatgctctcagggactcgtttgctacgctgccccctgcagatctgccccagaggagcaggtgaaaagccgcgcctgccgaggtgctgcagcggtggagttttgggcagaggggtcgggggaagagtttctcacttttaagattccccaaatccaagatgaagtcacactgtgctttagaatggtagatgctcatttatgtaaaatcataataaatgttacacaaactgttagaataaaaaaatacctttttcgagggggaggagctccccagcctgccgctgggtagtgagagggggttagcaccattagggcgtaggggtcgggagctccgccacagcccgtggtgggcactgaggtctgtcggtcggtctgtgcatcctggcactgtcagtggcgggtgacccgctgatggcctcgggagggggagccgtggctgggcggagagcacgagcggcagcactgggtgcggacggtgggcagctggcagcggcccagtaggcgcagtgtctcacagaacccgaaggacaggcggtcccgctcacagcctggagtgggggggcagagaggcatcagaaccagtggtttggggtacccagaacctggctccccaccccaaccacctcaaggaggctccagcagctccccaccaagcagagagccccagtttctggagcggctcccaaactggacttgcaggtctccaactgttggtgtctctgtcccacctactcacggccgaccccaggactcgagaacgggcgctgctgggctgaggtttctggaggaaaggtcctgagaccgcaccctgaccccctcacatgcctgttaaagagcctgcccagggcgacgccctgccatcccatctccatccttgctcacccctggtgttccccgacagatcctggcacagaactgcggtcccggggcctcctgccaacctgcagcggcctctgcccccgactcccgccaccgccccctgccccagtgcatctgtcctgccaggcctccgtgaccacctccagccacaggggctgtacacagcctcgggttctgagtcacaggtcgcatctcccaggccagcctcccacttctcaggtgggccaggaagcctagagagagtgggccctacaggctgtcagcggaaaccagggactaagcccaggcccagtggggagggaggccggctgcaggctgtgcttgtcagggctgaggcttggctgggccctcctgccccgtggttatcagagctattttgggaagtggcttgtttccagcctcctggccttgctcctgatgccactgccactgctgacagcccccacctgccgcctgggccctgcttactccagcagacctccctggggaggaagagcaggaggacagcagccagccctgtgccagggacatccctcaggcccggcagagggcacgaggcagcaggcaggctcctccaccccagctccaggcagagctccaaagtgcacatctgcaggcctgcatcctggtcgcccggggtgacctcagacaagctgcttcacctcttgggccttggttccctcctctgtcaaccccacctccacagcaaatggatgtggccatgctgtgtcactgcagcgactgcacactctggagtttcccggctttccccctgtcccgccaactgtcccacagaccagcaaaacatcctgggaattccaggtctcaaagtccaagacaccttcccagctgcccctccactgttcactggtggcagaaaactcctcacttgggacagcttctagttcagccacctaaccagcccccatagcccactccctgcagcccactcatacccgcccctgggagaccttacaagcccagagcctcctgggccatctgtccttggttctaggcccccaggggcctcagttcctgttctctgctccatctggtcctcatcccctgggatcataaccaccccactccctgtggccagctctagccatgaaggcgagagatgtgatgccagcacccagctcaggcagcacacaggagtgctctgagatgctggctgggtgcgtgctgagggcaggcaggacagggtgggggcactgccacttggccttgaggtaatggggtttgtggcaggaaggccacccctgccagaggcagggtagcaaggcatggcagcgaggcatggcaggggccactctgagcccaaatgagggctgcccaggagccagcgcaggtagagaaggcgcattggataaggggagaaggcagactggggagactgcagggggccccgaatgccagtttgagggccgtggctgaggactctgtcctagggtcagggggcagacagccaatagcacaggggccgcagctcttcaggccacagctcctggattccttagactggcagggtcagccccaggccctctccctgaccttgcaatgggggatgacagtggctttgcgggaggggaaaaagccgccttccctgagcaccacctggatccccacgcagtgctgtgcccttcatgcccagacctcacttatgcaaggatggggcttggcagcccctttattcagcacatgaaggccctgagagggaaatggagcccaaggccacacagctggtgaggggagcccaggtgacactccagggccaccccatttcctgccctcagcactgctgagagcagctggggctgcaggaagtgtgtgagtgtgtgtgtgtgtgtgtgttggaggtggggggttgggatatccagaaccacctctagctcaggcccttccaccaggacccagctggccaggaaaccccccaccactgggattagcaggaccctggaagggaggcccttcctgtggttccattgctcactctaggcagtcctctggccagggaatggacaggctagggctggggaggggacagggactcacccaggcccagttttcacacagcttcagggacatccctggtctcactatgggaagactgagacccagaggggaaagagcttacccaggttcacacagcaaatcaggggccaaggccactctctctactcactggaggtcagaaagctgcctgcaggatgttgtgtagctgggacttctcttgactgactcccagcacagccaagcctccagcatgggatcctgtggcatcaggattttcagtggctcctgagcccagactacagatggagccagccggtgccgtgggtgcaatggtttgaagacccaatttccccatcacccttcccgccccacctcacttcagcagagagcttggggtcgggggactcacggggaggctcgacgggctcacaatcctcggtgccacacagccgggagctcacaaggccaggcctcgtggccacactggtcactgtcttcctcgggtagccccgtctgggtgttgacacacttgaccagtgtgtgaccactggatgccaccaccacaggggcctgagcactggggggagcaggggaggaatgagtgtctccagggccagccctagcagtgggggcagggacacctcctctgggaagccgtccctgcgccctgtgcctgactggcctgcccttgctcccagccgccctctcagtgcctcctggaggacctgttcccattcctagagcccacttggtgctggaaccccactctcacttgtgggatcggctgctgcagagggaaggggcatgagaaccatgggacagcccttggggcggcagggcagtgagcccctcacacgggacatgactgagaggcctgggcaggggccccgggatggagccctgatgcagcagtgagcagagacgtgggcgagacaccgctgtgcccgagggacagggcagaggacctgccgcagcccatgggcaggaggggtggagacaatttcacagccggggcccagcccgccaggctttgttgttaacaggtgcaggtctgaaagccctaaacatgtgctgagtctgtgccagtgtcgtgctgtgcccggccctgtgctttgttgcgttcctccatttaatcctcctgaccctcctctcccaaagcgtcccaattttacagatgagaaaactgacccagcaaagcaaagcaacctgcccagagtcactcagcagccagtcggacagactcaaacgctggcccagctgactcccggacccagctcagggcccaaatctgagatttctgaacccctcagttccaaacaggcccagcagaaggtgtcctgcccatacgaggcccctcttctgcccccttctgccgctggcctttgctgggctccctgatctccccaagctcatcattcctgcctcagacttcacacctgctgtcccctcgatccctgtccttggcatcactgactcctccctcgggtctcaaccccagacccctcctcggaaggccttccctgacatcacagcacacatgccctttccttgtctgtttctccctgtcaggtgtgagcaccagcatggcagggctttgtccagtgactgctgcatgtgcaggggccacagacagcctggctcacagcacacactccacagctccttcacccaacccaggactgaccaggcgctaccaagcacttgctccctgctcccccccgcagcctggctcacctggccccagggccccaccacccactgtgtgcaggggtgggtgttgcagggccgggtggtgttgggtctcagtgcctcctcgcagaggtctggctctgggcaggtcaccagacgctgctgctcaccaccgccacaggccttggagcactgggtgggcagggaaggagtcagggcacagccagggtctgagggtgtcccctccccccaactcaacgcccaggcctcacctccctccaggaagacatgtaccagctgaggcagggctgggccccgcagggccagtgcacaggcagcttggcaggtccaggctgacaatggaagggccacagtggccagaggtcccatgtgtccacatgctgcatgtcccacactgaggaacctctgccacagctgtgggagcactggggaccgagagacttgtgtggacacatccccacgtgcaggcccacaggcgtgaccccgtgaggcgtgtggcaggaaaggcatcagacccacgccccagccgggggcaaatccctgaagagccccagcgagaggccaaggctggcaggccccaggcaaaaggtggcatggccaggggctgccatgggctgggacagacagagaaagggaggaacaagtccagatggggtcaaagatacagaggaaaggagacaggccaagccagacaaagatgagatgactcccaagagattcggaatccggtgcgatcaggcacatagacatgcagcctggagccctccccttccctgccgctctcggaacacaggccgtggggaaccagggctccaccccatgccctggggatgcctgtcctggctccatcctcatgcaccttactccagttgcctgagtgccaggtggcacagggccacaggtggcagcggcgggcaggctggggccggccagcggggtcgcagtcctcatcccggctggagctacagcacaccggcctccagagggcacccaggccacaggtggtggagcactgcggggcacagacccgtgaaagccaggcagagcccatcctcgccaggcctccacagccaggaaactacccacctaggctagcaagacctcagcaagacaggggccctcttctgggcctcagtttccttatttgcaaaataggctcctccacccacctcccaggaagaccatgagaatgaaaagtcaaatccccccagcaaccagccgtccctgctcacatgggacaaagggcctgtgtgccagtgtcattggtgcagaggttcgggggaggagaccctgtgggcacccctgaccagctatcctgaccagcctcgtcgcttcccagaggcaccagggaaggaaggctgggtcctggtaccagcagccaaatcgctgcctatccccgcgcaaaacaagccctgtgggcctcagcctgccccttcccaccccaaaattaggaatctgaacagaagcttgcttctcctgcagtgaccatctggggacccagggagggggcactagccagcttctttcatgcagctcagacgtctgcaggtcactgccaaaggagggtggagccactgagggcagagccaggtagcagtgggctgagtccagcctggaggagccagacagagcctcagggaagctgctgcctgctgggcaggactgggcctggtggccacacagggaccctccccactgcacagctgtctgagccagctccatcctggggcatgctgtgctgccagagtgtgcctgcccctgccttccctgaggccccctgtgctgcccaggaatgggccccaggtcccctcattcccctaatcctgggaacccccgccccaaggaaggcgagacagatggcgcctgcgtcccactctgctcattttcagatgaggaaatagtcaccaaggtcctgcgcaaactccctgcccacccagcccacaccacttgcctcgctccagtttcccacttgtcagccggcgttcctgacaaccaacgggtccgtggggggccccgcttcagccaggctgggaggcagtggctgggtctcaggggctctgtggctgttggcggggctgtcccaagctggcatggacagcagcctagagctcaggggcacctcagggctgagggactcaggctgacccttgggtcctgggttcagggcaggctcaggcgtgtgcccgaggccagtcagggttgtggggaggaaggtcccccacactgccacagtctgcaggtcccataagcctggtcctggggttgggaaggagggagtccccggctgcaggggactgtccttgcccttcatctctggcaaaggggctatgggaggaggagggagagaagccaccctaacagtgggccacagttcactatccacaggccccaggccaccctccagagctgactcccaggctactgtccctcctgtccacagctccgccacgtcaggactaggagaggagtgggtgctgctgaccgggtacaaagtgggcagcgtggggctgggtctcgggggcaggtggggtgctccgcagcccttgggtccctcatcatttgaaaacctcgttggtcctgtcctgccatggagagggcagctggctctggctgtccttgccaactgggaaatcattttggctctcaggggcggcaggcgtctgcaggccatcagtggaaaccctgggccagggcaggctggggagcccaagatctggggcccctatgggggtgtcttcctcaggcaggaaattgatcaaagggttcccaggggtctgctctgagggtgggggtggggagcggccggcctggctaggccaagggctcggggaccaaggtcccgttgccccttcctccttggctgcaggaggctctgtggcaggcacagggctacccgtggagggcgcagcaggacggctgtgtggtgggggcgtccgatcccctgtccccgccaggtctagatcaggctcctcagaaggcccgtaaggacagatcctcgtggaagctgatgaaattgtagtcgtagtagaagtcgtccacaaacacgggccccggcaggtccagctttggagcctcctcctcaatggcgttgcccatggtgcctggcttgggtgatgaggcgggtgaagggcgtggggccaggtggcgcgggatgaagtcagcctcgttgaagagctcgtggctggaggagccgctgcctgagccttcagggcccagtgtgtccaggggccaccaacagggtggcagagagcaggtgacttcgctggctggctgctgggcctcgtcataggggacaccggtgtcactgatgcagaggacatttcggtgctgagtcccttcctcatatgtcactgagcactgcaggggaagccagggtgaggggcttagcctgggaggcaggctgccaggggacgctggggcaaggctgggtaacctgtccactgcctgatgtcagagtggcagagaccccagccagccctctctggcccttcccagctcaaggccatgactgtggccatgcttgccaggggcttcctgatccctgaggctttagagtcaggggctggaccctggaatgcccaggttccctcccacccacaaggtctccaggaaggctgtctgcctccctgtagctgaagaccaagggtggggctggaggcgggcaccttcccatcccacactcacctgagaccagttccccacagcctacgtggccggacagggcacatggtggttgcaaggggtttcagtagggggccggggaaggtgttcacaggcgggtggcttcagggcgctctgctcatccagccccacgctgcggatgcagagcacagcctggcaggagaggcccccaggcccgcaggagctggagcacagctgccactcacctgcccaccacctgctgagggcacacaggtgtcatcagtatggcatcagacaggtggcattgacaggctcaccagcagggagggccaggctgggtttccaggccctcggggtttgggcagtgccagaagccagtggatgattctccagagctccaagctcaggtaagtgtcctgccctcaaagtctggtgacaaggcacagcccctccactcctgccaccttcccctcagggaaactgagcatgacctgaggcctatttccacatccagggacccaaagaggaggaccataggtgtccaggctggcccaggctggggtgagaggtgaccgggggttggggcttcagccttgggaagagaatgaaagcccggctccctctgctcctccctggggcctctggggacccagatgtaggggcctgtggcagacccaggatgcctgggggtggggagttggtaggggatgggggcgggctcacctggcagggcagggctgctggctgcacttcctctggcagtcatcgggccggcccagggggtcacagtgctcctcgtccacgggccctgcctgccgctccgagcagtacacactctgcctctgcacacctaggggccatggcgttcagcctgggactggcacccaggtgcccaccgcccaagacccaaagacaccctctctgccagaaccctcccagaacagcgccttactgcccatgtcaggatgaaggcagacctccaccgtcgcctccttgctgtcctcctggttctcacccaccccctctcctatgtagcttcccctctgactgcccctggaggggtggcagagtgtggaggtttagtgggttgggtgcccagaccctctgcatcctagctgagatgcctgggcagctcatttggcctctctgaacctcagcgtcctcctctgtgaagtgggagcaacaatcctgcctcctccatgtcctggagggaggactgcatgtgttcttgcatgtgcaggctcggcccgtgcccggcacatcctaagagctcgatccatgccagctgctgctagcatgcaaacccagccgtggctcctgccaccttcccctcagggaaactgaatgtgacctgaggcctatttccacatccagggacccaaagaggaggaccataagtgtccagggtggcccaggctggagtgaggggtgaccggggtctggggcttcagccttgggaagagaatgaaagaccagctccctctgctccttcctgggattggcttgggtgatgaggcgggtgaagggcatggggccaggtggcgcaggatgaagtcagcctcactgaagagctcatggctagaggagccgctgcctgagccttcagggcccagtgtgtccagggaccactgacacacggtcccaccatccacacccttcccaatggatcagagaatgtctggacaagaaatggggcatcaatggacagcccctgctctccatccccacaccagccttggcactgctccagtcctttacattctctgccactgtccaacctggggactttgcacagccacgttcctcaccttggacactcacttccatactgcctgttgaggcccagctgcaggaccccgtctgctggtggctctgccttctctgctccaccccctgccccgtggtcccgagagtaagttgtccctcccctgagctgccagtcccacatccatccccctctttcctcaccaacagagtctgattttgttcaaggcagcagtgggacctgctgaaaacacaccccactgccgctcccttgcaactaggggggtctgggacacagtcctggctcaggagaaaaaggcacaagtccctcgctgggagtcagccctttcctctctccttcttgcctagaacactgcaagagccctggaagggaggacaccatctgtggcaagcaggagtggaggggaggctgctatggcaaggatggtgtggctgagggccagtcagctccaggtcccgccagcttggactgtgcacctgggacttcctgcctgagacaaagaacccctgtctcttccagccaccacagggcacttgcctctgcagacgctcctaagtggtccacctgcgaagcagccaatttgctgaaaggcaattccccaaatgtctagtgctgcaaatgtatttgttggttttcacgtttgtccaattaaagacacctgtattaggccaggcacagtggctcacgcctgtaatcccagcactatgggaggccaaggcgggcgaatcacctgaggtcagcagttcaagaccagcctggccaacatggtgaaaccccatctctaccactaataaaaaattagccaggcatggtggtgcgtgcctgtaaatcccagctactcgggaggctgaggaaggagaattgctggaacctgggaggcggaggctgcagtgagccaagatcgcgccactgcactccagcctgggcgacagagtgagactccatctcaaataaaataaaataaaacaaaataaaataaaataaagacagctgtattagataaaatgggtttcctagctttggaaggtaactgcccagttctccattttcactttgtcatcataatagcatttgaaggaatgctcaaacgtctgtatatcagattcccgattctgagaccctgaggatactgagtgtcaacgatgggaagactgagggggaaaggggaggactaagagacaaagggggagactgaggtgtggggagatcgaggaacagcagggcagaccgagcagggggaggaagaccaaggggcgtcgggggggactggggggctggggggagaccaaggaatggcgggggagaccgagccgggggaggaagactgaggggcgtggcgggggtactggagggccggagggaaactgagggatattggggggagaccgaggggtatgggggcagaccgaggggtatggggggagaccgaggggtatggggggagactgaggagtatgggaggagacggaggggcagaggggagactgaggagcagtggggaggagacaaagagacagagaggggagactgaggagcatggggggagactgagggaaatatggggaggaagagtcggagttaatgaaattgccctacttttcataaatagttcagggaaataagtcatgtggtgaggggcctgggctggtctccgggacgcagcagaaatgcaggcacaaaacctgccggagctgagcaaggacaaaatcaagggggagctgtgtccactggagggagaacgccaagagctgcagcacactgagcacacgccgcgagccagcacccacctgcctcatccatttaccctcccagtgggcctgggacatggggcggttgctagcctcatctcacagatggggaactgaggctcagagaagcaaacttctaaacccatggtggcccagcagtgagctgggagctgaagccggtgtccctgtccagagatgaagcccctgctggcggggctgtgcctgccccacttctcacctctgccacaggtgactgtacacttggtccagggcccacagtgccaggagaactcgggcggcaggacctcgccatggccacctgcctccctgtgaatggtgtactcgtagtgcaccccagggttgctctcctggaacagcagctgggtgggcaggcgggggcccgtgagcacgaggtgtcttctccatccacccagtcttaaaggagctgaccccagccacctctgtgaactgcagctacacagttgggccatcttaaagatggggaaaccgaggtagaggcctcagcaggagggtctggctcagagccaggctctgtgactaacccagggctcactcctccaggacgagacctaccatgggaggtgctgggcctggggactccgcctctgctccccacgcctgggcctcgggaggcaggcacctggatccagacaggctccttggtgggacccggggacgtgaggttctcccagttgcccctgcgtgcgtatgtgacggtggtccctgccacctggtagtccccgttctactggatggtccagccaccattgaggaagtacttctccgggtcctcgctctgcagtgccaggaagttggcagcctcagccacctcctggatgcggacctcacgtgtgctggctgggatcagccccacgtccacataccctgtcaggcaagggttgtgcctggggtgagaagcttgcttatccccacctgctcccctcacatctctccccacttgcctccgcctgctgatgccaaagatttcgccattagctttaaagtctgagctccccaaattgctcggatctgtcatgggtcaccaaaaccttgcggaggtgccacaaatcctgaccccgtggccatgccccgtcactcctctcttggggacctaaactggtctcatcataaggctggatccatcccctactctaagggccggctggcattctctttctaaaaaaaaccaaagtgcccaggcctttctcctgggacaccctcctcatccccacgcagcctgcttttattcattcacttccatcacacccatcacgtgccgggcactactctcagcacttcacatgtgtaagctcatgggtaacggccctatagcatggtactattgttaaccccattttacagatgagcaaagtgaggcagacagggagagtaacgtgcatgagcgtcctgctgcaatataagcagcctccagggccagtgctttatccaccacactgcactgcatctctgggatgaaatctaagcttctcagcctggcactcaaggccccatagctggccctgccttcccttcttgcctccagggctctggcgcaagctctttcctccatttggaatgcccattccatctcttctgagttttatgattcagctcaacttccgcctcctgcaggaaaccttccctgacttccccaggccaggaccttcttcctcagtgctcccacagccctctgggcctccctccactgcactgatcacaccagaaggttctgtcccccttcaggactgagcgcttcacctgcatgtcctcatcacctagcacacagtcagtacttcagcaacatgtgcaaaacagaccagaggtgagggcatggagctgggggtctcagaagattcaggaggagactaccattctttgaaaggcccaggggccacacacaagtcggggtggccctgcctggggtctctgggacaggaagactccccatggggacaggtctctgcgtgtgggccaggggtcccctgactcctgcaagaatccaccccagcaagccctccctgcttagccatctctaggctgggtgggggccacgaggccaaggacaggggcccgggggagatggggaaggggccaccaggtgaagagcacacccctccccacagtggtcccaccccatacccaggccctcggcctcctcgaaggtcccactcacggtgtggcaggtggagccgttgccgtggcacacgccacagcggtcctccatagtgccagagtcaatctcaaagtcacagccccacgttctgcaacacacgaggaggggaggcccctggtgctggcggccagccctctgtggccccagccccgggggccagccagggtcaggagaagaaagctgggagtgggggtcgggaggcctctctctggccctgccccaccccagctgtgcctctgacccaggtgaacttctctacctccctgagcctcagtttcctcagatgtgagacagggagacccacccctcccttaaaggcatgtcatgagcatcacaagagacaagagaagggaagagttctgcaaagcctgcgggcaggcaggggatctgacacgccacgggctcctgagcagcgcgtgcagggaatttcaacgtcaaaggcactgggggttggcacctccctcctggtcctcctcggagcccaggccttgataccccagtggtttagagggcaagaagcaaggacaagtaggtggctggagacatgggtaaagaggagaggccatcgttgttattaaaaataagaatataaattgttaccaaacactgaggcctactcttcagggctcagagcccttcatgtcacctgtgccacctcatttaacccctctatcagggagcaaaccactgcctggggtcagccagccagcaagaggtcaagccactgcctggggtcagccagccagcaagaggtcaagccactgcctgggctccgatttcctggctggggcggtgctggtgcaggcatccaaggagacgcagtggggcgaggcctgactggggggggtccccagtgccaggaggcgtggtaggggctttgccttagaggtcatagaggataggggctgggaagcccaatggtagagcatggggagggtggcccgaggaggaccaggagagaacctggggcccgccagtggggctgggggcaggcagtgctgggagagcctcttcctaaccaggcacaccttacagatgccattgatgcagaggtcccggctggctcggacctggtagcagggggtgccatcaaccacggcgtcccgcagcttcttggcaaagtactcattcgcgggccggcagtgcagctcacaggggttcactgggggcccaagtagaagagtcatcagcaacagctggagcgggagtatggaggccaccaggaagacccctccgtgacacacatccatggcaggctggaggctcccaagcagcacaaacatgctggaggctccggctgggctggtagctatctgcaaggctgcagactggggagctaggggcgagcagcagccccaggggacagtgggagtggcccaggcttggggtggagactgggtctcctgcttgcatcacagggtaaccttggacccacaccccgctcgccgccctctgagtctcaatgtttccatgggaggcagcactcaccgtcattgaccatgggcacccatgtgtgcagctggccctcgtagagcatagcgtcaaagtggctgcactggacgtggcggaaggaggggcggccagcggggcaggcctgcaggttgcagaggcggaagcgcttccgcttacccacacagtatctgcctttgtatctgggcctgtggggagaaccggggtggaccccagtgagggcccagtgagtgctactgcatggccacagcccagagcaagcagcttcctcctgcacccacaccccaagatccctgctgcccagctttgtgcacgctgcttccctcccttgggttgcccaccctgtggcccagacacaccctccctgtctgtagggacctgtggggaggtggcagcaggaagcctgagctctgcccccaacctgctgtgtgatcgtggacaagtcttcggccaccctctgggcctcagtttcctcatgtataaagtggggttggggctgcccctgcagagggctgttgagaagctgggacaagctgcaggcatgactggcactggctggagggactaatccgagtctccagcccatgacaccagcatcctaacgagcccttgagtcctcagccttcctcctggtggcagtacccccagcctgggtctaaaggaagcgcccagggccccagccagctgaaaggtatgatggagcacagctcctgaaatcctccacatttaggccagggtcgctggcctccactcagctcagacctggaggccaggaggcagggaggggcacaggccagtcttgggtaagcgcagggccctgggtggggccgactgtgaaccccatgcctgccccgggtggcctcctgaagtgaagatcagccgggtagtgcctcggtctacagtaccactggcctctgcttctcaccagatcttcacaccccctgcgcccccccatttagatggggaaacagagatccagagaggtgaagtcactcacctcaggccaccccttcagtgctgtcccatcctcccagctgctccatctcatctcaggcccttgttgtgtctctgaggccaccaagcccctcctgctgagtgcccactacagatgagctgcagggctgaggggctggcctgcataaactgcatttgcccctgactacaactttactggatgggcactgctattatacaggtggggaaacggaggcccagagaaggggtgaagaggggattcgaaccctgagccatctaaggtccagggcccatgctcttccccactgccctctcctgcctccttccagccagcagctgctttgccatgtggcctctgatgagtctctccagtctctgggcctcagtgtccccctttctgcaaaggggtcagcagtggggaccctgtcagccctcagaacactccttgaaagtgactcaaggtggcctggacactcagactgaccattatgaggacacttctaagagccaggggctggcacagagccaagctcctgcaatcggctgactgcctgggtccctctgtcccattgcccagggcaccctgggccccacactcacataggctgcatgcactgctgcttggctctctgtatgcccacgccacagctccgtgagcagatggaccaggcgctccagccagaccagccaccatccatggcctcgggctggaagcccacaggtatgcactccccattgagacaccactaccgagacagacggaggtagagccaccccacccccaagcctatcagtcatcctcaccctagtaagaacaaggtgtgtgagaatgctgcaaaaggcacagaggggaaggatggaaggtgagagaggccccctcgcaatcatcacaatcatctgtgacccaggccacatggaggcgctgagcagggagtaaaacagcccacgtgctgactcagctgaagacaccctggagaatcatggaatcaagccctggccccaatgcctccactttgcagacgggggcttgggctgcagagggcatggggctctctgtgagccggggctgactccagggcccggtcacagcaggaggtctggcctctcacacatccactgccgggactgggaacatcgcctaccttattctccccacaccggatgccgtccacggctgcatccagcttggagtgacaggtggtccccacagagcaccagagtgtgtggcagacattctgcgaggaggagggcatgggccatagcctcacctcctccccagtgccgccacccaccctgcccccctccctgtccccaagggtccctgggcacccctccacatggcaggggcccacagacccccagaggtcccttcttgtgtgtctgctcccaccttcctccccagaccacgtggtggtgtggggcgcccggggctgcactgctcagagtggtcctcagctgtccacacctctcccggcccagcgcctcctctggaaacactcctgttagaagatcacttcaggcgatcttcgccaggataaatagaccctccccacaggggttccttttccctcttatgagccagctccagagaggcgaagggacttgcccgaggggtcacagtcggtccatggttgacccagaattcagagctgggtctgtggccgcccatccctggcctctcccacaggccacttgacgtctcacagtgtcactcaggggcgtagcccagcccaggcgaggttgctcccaagctggcatccacaggctggtgaaagctgtcccctaagccctcctgtcgggtccccacacccccacacccacaccggccccactcacatccatgtcctcgcagaaggcagagtaggccccatactggaggtggcactggtggctcacatcatagaggaccccaggcagcactgatgggaagtcaatgatgtccttggcaggcgggtcatccaggcacaggctccacccatggctagagatgggacgggaggatggaggggggcgcagcctgtgagacccatcggagaagcctcggtgggaccaggagaggaggagaggtgggagggggcacagagccctacaactgtaggaaactccagcctccccgctcggctcagccgatcctccacctgcagccagtagcacaggccctcccagccaatctcatctcacctcctgggcactccagctggctaaacaaccccaaccccaatcccaggcctctgcacacgctgccagggcccttccctcagaaggcctcctggaccgccaaaccctcatgtggccctgctctccgaccctgcagcctccgtgtctgagcccagaccctggagccaggcccgacaaggatccggagaatatcacatcacagttgacacaacagagcctccgacggccccacccaggcagagacctcgggtcatctgtggaagggcaaggtctggaaagcagcccctcccctgggagagagcctagggcatccgtgcctgtcccctgtttcccccactccccaacagggctggcctccagcctctgtcataccctatctactcctgccttcctccagctggcattccctggcagcggtggcggggaaactggcagacacgagcaggtgccatctgtgtccaccacacgctcctgctgctgcggtgtggcgaagacaaggctgcccagaccaccacgaggcagcgagcgtggagtccggggccctggggagggcggcccaggcccagctggcacctgcttctgcccctgcctcactctgtacagccctcaggcatgctactgcttctgggaccagtgaccagcctgctgtacctgctggaccttaggcggccactacaacggcttagcagcaggagtgccctggcatgctgaccagcccacccacagctcattgctgtcctggaggaaggtttggggccctctgcggggcagcagtggctggggagaattgagccatgcagacatgcggggctggggatgacccaggcagccacgacttgggcagaagcatggaaggaggcaggacccatgggacctggggcctctagccaggcaggggagatggggaggcaaaatccctccagttctccagtctgggtggactcagggtaggtggtgccaggccagatggctgggatgagcatacagtcctgattgggacaggcagggggtcgcacagggaagaagggcaaaggtgatggatcctggagtccagcagggagagaaagagacactccgagatgtggagaggctgggagaacacgaaagggtcaggaaacagggccaagagtgctgaagacaggtgtggagagaggctaggagggtggatcagaccatggaatcccgaagcccagatttcagaggagggggcctggcagctgggagacccagggtggggtgggtggtctgtgtggtctcctaagtcccctggccagtgacaggcccctgactctgcccagagctgcggagaagaaagccaaggtgaccagacttctactgagaaccctggaatcctcctggaatcactcagactgcccatcatggctggaaacagatcctctaacatgggcgttggcagatgagcagctgctggatgcagtcctagtgcccaagatgaccacgtgccagactggtccagggtgctgggggcataccctctcatttgctcctcacaacatcctgggcagactctaccatcatcttccctcatgcactcagggcccatacgtcacttgtcccgggtcgcgcaagagggacgtgatggccaggacctggagccaggcccaggctgcctgcaccaggctgtgtctactcactgggctacccccagtgcagggctcctcccattcaactgcgagcctggcctcaaatacttcaccccacatacaagttcaaaaccatggcagcgaggcctggcagggagaaaggagtgtcccaagttctcctgcggcttggggctccctgagcctccctgggcctgcacccagggcagagtgtcagccgggggtggtggggtcagctggccctgggctccctccttcccgccatcattccgtggctcgaggaggtagactgggggctcacccatcccagccagggggtcctctgacccaggggctgaggggtccaatgcgcctcatcccggcaccaacagtccctgggctgcagccgagcccttttgtttcctggctgccccagtgctgactcgctgcacatgtggctcctgcaggcctgctgctgggcagctgaagccgcaacaacctctcagcccaccctggatgttgggagaagttgggagcataaggtgaccctcacagaatccactgccagaatcaggcccaggtgctgtcttgggagtcagaaactcaaggtggccgtcagccagcccttccttcctctggcaggctgactgccaggttctctgcactgccgacacacccggatcccccaaaccatcagcccttcccctccacgcccctccttaagctaactatagcagggctgggcagtcccacaagaggtcaaagcagacagtaggtgactccagtcagaagcttcactctcacctcaagactgcaaagagctgcccaccactgacaggagagacatgtgggcccgctcccctggccacccctgggatctggtcatggagtcactgcatggggtgtccatggggtgaagtgaaggaccccacatgttacctagcctgcctctctccctgtagaaatgctggctttgaggaaaccagggaccagggcctcccctcctccccacccaggtccaagttgacactggcgaaatgctgtgacctctccccaaggtcccataaagcacctgtcagcccagaaaggttcttagagttcttcaggtcaaccctcttggacaggccagtctaggttcttaaccaccaaacaaaactcttctctgcttccaatcccaccccccaccccagtaatccctcttccactggaggccagtatccttgctcttacatccctaatggacctggtcacatccctgcttaagccccacagtgagtggacttctagaaaaacatggcacattgagcagacagatttatcgctgcttccttccaagactccactataatgacagtagaggaaataaacaaggcataaatccataaggggtgatgatgagtaatgaaggatgtcaacaagattctggaagctgggaagcagatggccaggcagtagctgacttgctagagtgatgaaagctgagagtcagattcctgcaggggggaaccacccagaagcagaagcccgaaaaggctcaggaactgagtttgcagggactcctcagggccttagtgccaggagggctgaagacagtagggctgaaagtctgtaagaaccgatcagaccctagatcccctccccaaccctgagtagccaagtgacggccacctgccatccagcagagggccagggatcacttcctggagagggtgaaccaggaggctctggcccaggaacggtggacacacatgaaggcccaaggcagaaggacctacagagaaaaggggacaagcaaaagtctacacattgaagggtaagaaacacgccaagcccctttcccacttggatgctggaatgctgcagccagacatacactctcccaggaaaagtcgagaggattcctctcaggaaactgaatcactcagaaaaatgacctcagatagtgacattagaggatctccccaaaatagccccatctgaaccagtccttcagcagtgacttggaaaagtcctgcccaagtccacaaactgcccaattagtgtctctgcatctccttgctatatatgaaatacagccaatgcattttaagaaaacttttctttgagacagagtctctctcttttgcccaggctggagtacagtggcagaatcttggttcactgcagcctttccctcccgggttcaagcgattctcctgcctcagcctcctgagtagctgcaattacaggcatgagccaccatgcccagctaattttttgtattttttttagtagagacaggatttcaccatgttggtcaggctggtctcgaactcctgacctcaagagatctgcctgcctcggcctcccaaagtgctgggattacaggcgtgagccaccatgcctggccaagaaaactgttaacatgaaacaaatatatttttttaaataacccaaaggaaataaaaacatttcagggaacagaagaaaaaagtcaaatccgtgtaagtaataacctcacagagataagagaacacactgtacccacaaaacaggaataggatcaaaaggtgcacaggttgagtatctccaatcccaaaatccaaatgctccaaaatccaaaacttttgggcactaacatgatgctcagaggaaattctctttggagcacttcagattttggactttcagactggggattctgaactggtaagtataatggaaatactccaaaataataaaaaaaaaaaatccaaaatctaaaacacttctggtcccaagtatttcagatatgagacacgcaatgtgtatttagtgagtgagaaagttcaagaaattaaaagtacaatgaaaaaaatcaaaaatttaatagagggattgtaaagtaaagatgagtcagatacctcctagaaaatagagatggctaggcacggtggctaacgcttgtaatcccagaactatgggagactgagagaggattccaggagttcaagtccagcctaagcagcatggcaaaaccccatctctacagaaaaattaaaaaattagctgagtgtggtggcatacacctgtagtcccagctacttgggatgctgaggcaggaggatcatttgtgcctgggagctcgaggctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaggtgaattttcttatacacacattttaatgggctcgagcaaacatttttggactgaattcatagaagtagaatttctggaggaaaataatttttagggtttttaatagaaattttcaaatcattctccaggaaaagtgactcaggttatactcccaccaacaaggacagagctccagggtcccctttccatttgtcatctttcctgcctttatacagaaaatctcattgttttcatgacatttctttgatttcttgtgcttttgaatctttgtatatgccattggccatttttattcttgtgagaagtgccagtttctccattgcccattttcggttgaaaatcatttgtttttttttctcagtaattttaaagatttctttatagtctaaggatacaagccttttatctgtcattgaggtgacaaaactttctcccagtaagtaatttgtcatttcattttttcttcttttctttttcctttcctttccctttctttcttttccttgtttctttctttcttcttcttccttccttgctttccttttctttcttgctttccattcttactttcttttcttttccctccctccctccctctctttctttcctctttctttttctttctctctttttctttcttctttccctctctctctttcttcctttcctttctttctctttattccctccctccctccttcttcccttttttttcttgctttctttcactagccaagctccaaagtcacatttcacttaatttttatcctgccaaatttgaaagccttttaacttcgtgattttagtgtaaacaggagcaggagaaaatgtaattatctaagtctcgctgtgtcacccagactggagtgcagtgccataatcatagctactgcagccttgaactcctcgcctcaagcaattttcccacctcagcctgccaagtagctaggactacagctgtgtgccaccacacccagctaatgttcaaaaatttttgtggagatgtgaattctttatgctgcccaggctagtcttgaactcctgacttcaagtaatcctcccacctcggcttgccaaagtgctgggattacaggtgtcagctactgctcctgactgagagtttagttttgtttgctagtggtgttcttggtatcttttcatatttgaggttttgggctagtgctgaagtattacactcaccatccgaggtctacaggacttttggtttaatattgaacagatggaactgtttagttctgcatctttgcaggtatacagaatgtgcctaccaggaatctgctttatatccattgaaagcaagaaataatacagtaaaactttgcctggctagaggctttgaaagaatggcgtattctggtttaattctattactttggaagtataaaggtgaaaaaaattcaaaacttaaatttcctgttgaatgcaatttgaaaatatagccaatgattccacttttcttctctagtaaggttggacattctgatctacttggtgttttattatagaactgctagtgtgcgtgagtcttacattgtgaagatacttttttaaaacttgagatgtaagaggatgtaaacggttttgtaggagatcaggctggatgagaacggacacttgtaaacatactttttagactaaatctctgattgccgcttgtttttcttatggaactcatacaaataaaacacattggatggagggtgcgagtaggaaggagattcttgtcttttaattgcatgtcattgtttcataacaaggcagaacatatggtaaccctggctttggacctacagaaggaaacacatttttctacctgctgtatgccagaggttcttgaacacttggagggattactgcagcacagattgctgaaccctactccagagtttctgattcaccaggtccagggtggggcctgagaatttgcacttataaaaaggtctcaggtgctgctggtgctgctagtccatagactacattttgagaaccactcttgtctattaagtgtaaattgtagaactctagaaaaaagcttagttcagtctgggataagaagcacacaggttatggagaaaatcatgaaagattcaacccttgatcccagcctagtgtggatttcaggtaacaagcagtacacagtgacataacacaattcttggttttcatgattgcaagtcatagccaggtatcaagtgagaaattcagtttcatttgcaaggcctagagaggcctggtgattctagaaaaatgggccttgtatttgttttaaaccagtaaagagctttaagtgcttattaaattgtaagttttgtgttcctacttattttgtatcttattttattttattttatttcttttgagatggagtcttgctctgtcacccaggctggagtgcagtggcatgagcttggctcactgcaacctccatctcctgggttcaagtgattctcctgcctcagcctcccaaatagctgggattacaagcacccaccaccacacctggttagtttttgtatttttagtagagacagggtttcttcatgttggccaggctggtctcgaactcctgacctcaggtcatccacccacctcggcctcccaaagtgatggcattacaggggtgagccaccgcacctggcccaaaagctttgtgtttttaaagatattagacatgtttcttgtttttaaaagaaatcttaacaataatgtaggagaataagacaaacatttttccaaaaaagagaaattgttgtgattattctctgttattggaatgtcggatactatagtcagcttcattaatcatcaagaatgctatggattttccatttttatagggtctatatctcagttaaggtaatacttgtaattcttgtgctccatttgaagatgaaaaatataggccaaaatcatagactttgcatagaagctgcataatgaagacagctctggaggaacacatagatacacacagacacacatatataaagtatatacacatatattttttaaagtttatttttaacagttttaaagcttttaaagcaaaagccagcccctcccctctcccagagtgggcggcccctcccctctctctgagtgggcagggacagcggttgcatgggcagctttccttatgatgctacaggtccctctggacatgctgcgcctggccacgcctcctttccctttcatctttctcactgaccaatgggcttggaacattaaggccacgcccctattctgcgttccattggtgccctggttacgccacctgtggctcagttgcacagctgcctggtaggtgactggaggcattgagcagtgctcactggtatttcgctgatgtggccccaaccccacctccctccccaccccgcgatgtcagaaaaaacacaacaggggaaattggccgcagccaagaaaaaggtaaaacacaccaggtcatggcccccaacccagccacagatcccctccgatgacaagaccggtgccagagtccataccactcctgaggcataccagatggggccccccaaccccagcccctctgggctcccccaaccaaagcctagtcagtcagccccaccccttcagcaagcagcccagtccctgcccttgccaatcaccccagggtgactttgggcaggtgactcctggggctccctgctccataatcagccctcacctcctgccaccccaagcccaacctccctgggctctttgggcttgcgtctcccaggacctgggtcccccagccccaggccctgccctcaccagtcatccctgggtggctttgggctggtgactcccggggctccctactgcagactctgccctcccctcctgctgccccaagctcgacctccctaggcttcttgggctggcgtctctgaggacctgggtcgaaaccgtgtgtttccctcccccatcgtggagcagcgactcgggcatcgcgctgatgtggtcccctcccctgggaggagtggaatgcaatgatgtcacagtgcccctaggaactgtcattactgctgcaagaccagcctttgatcttacaacccagtcccctaagttttctcaccccatttctggttcctctggttgcagcacaaatttccagctggaaggggagtggagactatgggacctaggagcaagaggtttcaggctgccttactcccttaacatagacattgacagtgggaaaagcctacacttcccctgtgagctcaaaatgttcacagtatctctgggtggcaatgggagaatgggtttggtttggttttttcccaggcttctactttccagagagactttaacatttttttctgagttctccacggttctgggaccagactgcccttcagtcagtggcctctgaagtgagatttgctcatcttctgtggaatagatcttgggaaactgaacttgacagcttgaatcttcctcatatcgtctcaacctggggtactttgagtgccacaggataaatgcgggacatctttctgaagcatcattttcccttgattctcttgagaaaatgcattaatgtacttagggatgacagacacataggtttccaagcgtataccagacttcgctctgaaatgaggcttgggttgtcctctttctgataaattcccagatttaatagaaaagctgccttctgccatgaggacacattgatatgaaagtgtgagaggtactggtacgcttcttcacgctagcagacctgtgaggatgtatgactctaaaccacacggcctacagttcctgcctgcttaatgtgtgcttttctacctctgcccctggttttggtccctggaagctgctgattcatggcaaaaccccagagcttggagtcagaggactgagtttaagttccagtattgccttttttgatctttctttttttttttttctatccatgatatcagtccctctcagtcactaagtgattgtgacaacaccttgtacagttgttggtggcattacatcagatggtatataagggtattttgtcaaaactgtaaaggaggatgtggctgtaggggctgatcattctcatgagtgttaccgctcttctttcccacagttaaaagcatattggcagaggaagagccctggcattccagcaggagctaacaggaaaaagaaaatcaatggcagtagccctgacacattcatttctggtggttaccactcacctggggatgtgagtctcggcgggccaggctcctggggacagggagcccaaggggcagtagagggtaattgttaagattgtagatggactgttgggtactggttaagaattctggatttgaatcctgcctctccgtctgctaagaattgattagggattgattagcatatgatttagggcaagttgcttgaggtctttgggcctctcttttcacatctgtataatagaggtggtattttttgacttccatttgtgaagtttaaatgagattcgttattgttgcttttatgtgaatccttagtacatggcctgctgcaaacacccaggacaccgaggaaatggtcgttgctgtttgattttcctcatccccagtctcaaggggaagccaggccaatgagaagagccacttgccatcaggctgtccctttaggagtcactgaaagggccccagggtgggatggtggggagataagaaccacgagagaagttggcacaaaggagttatgggaaaaaggttccaagataggcagaaaagaagcttttgccagttgatgggggaagaaaggaagtcagagggcttagacagtgaggggggacagaacatctccatgtgcactctcatctcttggagtcagcaacaggtatctacggggagggccgtgcatcctctactaccctgcaggatctggaggtaagaggccctgggccgaggtgcagtgaccctgcaggccagccctccaacctcctcccacagcaggggcttgttgcccctctgccagctgaggcagcccacacacccccaccagccctaatgattattctctctacccctccccacaatcttcctccaactccttctctctgcatgcacctcagagccagtaccaagaactagcagtagccctggattcaagctccgcaataatcagtcaactcactgaaaacatcaattcactggtaagagtccagtggggtcccctgattacagctggtcaatcctggactccagtttcctcttggggccctgaagaaaggggctaggggcccctgatgccaagggcaaatggggagctgggcacccaggtctcacctggagggaccccagagcacagaacatgcagcatggctcttctgcactgccctctttgctgactctctcttctccagacacccctgctctagtccttgccacacatgccctggggttgtcacctctctgggaagcactagcctgactggttgtcagaggtccatattcctgccctgcctcagtccctaatttgctttttgagtctggacaagccatctctcctctttatgctcgtgtttctggaggaggtagagagtatcaaaggtctcggttagctctgaaagtcagagatttaaaggcccctagaatggaaagctcagggcgaagggctcctgtctgtcctttgctgttttatatctctgctatgaagaactgtacctggcctgtacatgctcagtaaatgtttgttgaatgaatgcacgtttctaaatcacaaactggcagaaggggggtgggcctttctcaaactctgtctctggacgttcaccagcccctccctccaggacccttttccccctttgctttgggtaggttcgcacatctaaggaggagaagaagcatgagatacatctggtacagaagcttgggaggagcttgttcaaactcaaaaaccagacgggtaagatggggctggcatgacctggcagctggactggcattagagggctgtgggggtgacttagaatgccccagggaggtgggtggatggaagggctttgaggcagagggaaagaggtctgtgccaggggaggacaagtcttgtcatctccatgagcctcagtgtccccatcagtaaagagggaggagtgcccattgtcagccacccacagtgctctctatctgaaagtgacttggaagattgtctaccatccgggtgtgaggagtcattagcagtgaggccaagtttgggaagcctgagaggaggagctgtgcaccaaagggaggattttttttttttttttgagaatccagaggcccttattctctgcttgctttctcagctgaacccctggccccacagcccccagcagggccatctaaggtggagcagctacaagatgagaccaaccacctaaggaaggagctagagagtgtgggaagacagctccaggctgaggtggaaaacaatcagatgttgagtctcctgaacaggagacaggaggagaggctacgtgaacaggaggagaggctacgtgaacaggaggagaggctgtgtgaacaggaggagaggctgtgtgaacaggaggagaggctacgtgaacaggaggagaggctgtgtgaacaggagaagctgccagggcaggagaggctgctggaagaggtggagaagctgttagaacaggagaggcggcaggaggagcaggagaggctgctggagagggagaggctgctggacgaggtggaggagctcctggagcaggagaggcttcggcaacaggatgagaggctgtggcagcaggagactctgcgggagctggagaggctgcgggagctggagaggctgcgggagctggagaggatgctggagctggggtgggaagccctgtacgagcagcgggccgagccacgcagcggcttcgaggagctggtgcgttgccccacctggggaggctgccctcttccctagccctcaaggcctttgtttccccacctgtaaaatggggcattgtagccttcacatgaaatggtacttctaaaggcatctgtgagccagagccctgctctgatggctgtgggagagaggggatatttttctaacctgcctccacccttcccggtgccatgggaggcagacactaagttctggggtctccagttttagtgggtggccactgattgcttctttctgtccagaacaacgagaacaagagcacactgcagttggagcagcaagtaaaggagctggagaagtcgggtgagctgaaagagactgtaacctccgacccatccaagaagatgtgggaggcgggcaccagcctctggggaggggaggtgccaggccacaggcagctgcagcctggggacaggtgaccccagcaccctccggggcagtcctatgactgtttcttgcttcctgccctctgacttttagaggtgggtagccctggggtcctcccaggtctggacatcatcatcccagctagaggcatggagccccccaatcacagaggaagagacagtggtataagaggctccttatgtcgggtgtggtggctcacgcctgcaatcccagcactttgggaggctgaggcaggacaatcacttgaggtcaggagtttgagaccaacatggccaacatggtgaaagctcatctctactaaaattaaaaataataataataattagccaggcctggtggtgcatgcctgtaatcccagctactcaggaggctgagacacgagaatcacttgagcccgggagatgaaggttgcagtgagctgagattgcaccactgcactgcagcctgggacacagagtgacactctctcaaaacaaaacaaaacagaaaaacaaaaaagactccttagattcaaactggattccggcctcggttccactggtcataattcaactactttgcatctctaagtctctgtttctttaacttcaaaaggaagttagccttttccttgcagaggtgctgaggattaaatgagataatacgtggaaacattaggcatgtagcacacttagcagatggtggttggctccgcctgcttttccaccagtctgtggcctacagtttacatgctgggaaaaaggacgtgagatttgatgctagggaaggaggcatggggttctaagcaagggagacagtctcttaggcctggagcaaggggccaggggcctgggcaggccacagagccccacagtgccctcgctaccctattaatgggccaggaatctggaagccagccaccacatgtcctcatgcccagggtcttccggcaggtggagctgaagagccaagaggctccgagtctgcagcagcagccagaccagtacctggagccccattcccacaaggagcttggatgtgcggacaagcagggtggtgagtagagccctcaggcggggtgggcaggcaggagcaggggaggctcgcactgtgcccagattcccaccccctccctctctctgaagatcttagtgagctgagcctcactgatagcatggaggctgcaccgggagaggacagggagggttctcccccatgacaaccccactgcacagcagatccagcagctgcttcctctaatgcaggactccccaggagcacccaggcttgagtggagaagctgttggtacaggagaggcggcaggaggagcaggagaggctgcatgccattcttttcgggctgccgagaacagggagctaaacatcaccatcatctaagagcgggtcaagaaattgaaaaaaaaaaaaacaaaacatttaaggggttaatatcctacacaattcatttacttcatttgaatgttagagccacttatgtttgtgtttctaatttatagtttaaatttatttgtgtttctaatttatagtttaaatttatttgtttctaatttatagtttaaatttatttgtgtttctaatttatagtttaaatttatttttgtttctaatttataatttaaatttatttgtaaaaagttaaatgagagtgggtctttctctcatgttcactctggcatcttttagcatttttttaatttgataattataggacgttagcatgcatatcgagtttgcccttatgtggtgggagttcaaacacacaaagacccactgtatgcacacaactgttcttgctggtttgggataggctgccatgcttttttaatgttagtacagcctgtatattcattacggaattcagataaaatttccttatgttctgctgttatgtttgatcgaatcctaatcacagtgagctcttcattagctcaatatgtggtttgccctctggaaacagcctttccccctttttctgtgtattggggatgggagtaataacattttggggaggtttttaaatctcccagaagaggaaagtggcctgctttggcaggtgtgtgcaggatagaatatgtttcatttgttccggtgccaagaatgagcgctgtactacggtagttcccttaggatttgtatgtgctctaggctcatgaagatactgcctcatgagctgtggcagttgtactcttttttgatgacctgaaaagggattatttctgaggaatgaaaggctcccatcatgactgtggatgtggaaaaccttttctagctgagagcatttatatctacaatacattttaaagtcagagttcatgttccctgttttaatcacatgactacatgtcccagtacacaaaagggcactggttggcgttctccttaatgtatttagtaaagatcagaagaaatcctttaagagtttaaatgcccctggaacaggcatatacaggctctagtcaagaatgaattcgagtgaaggaaagctgtgtgacacctggcattcctctgtgttcatggagcttatttgaggctagaagatggattttaccatctagacctctctggctaatagctagtcttcaaccatctgacataggaatttacttcttttccttgaatggagaacactttaaaaataataacaaacattattataaactaatatatgtgagagtacttagttgaaacaaaaaggagttttagtagacagtattatactacatttgaaaatcaaggagcagtttatgcaacgtaaaacgtttacaaactgcagcacaatctactgttcgtgaatgtcaaagtgtcatgaggaaagtgtctatacaatcacagagttatatttcctcacaaagttctttacaaagagtgaaatatgtttttatacctctcagtttcagttagaggcatattttgtgtaatatttatggcttaaaatggactaaaggtcctgttcttgccttgtctgaacttgccgcttttgcattctttgagttcagtttaaagacagttactttaagcccattttaaaccctcaggctagaaatcgtaccactgttaattagccacattatttggtctaacagtttttgtttatcattctgaaactgagcttacctaatacattgataaattatttcaaaggtatttttatagttcaaatcgcttcacttttaccctgacacgtataaatgactaggaatgaccttcagatagcgtttagcaactgtaaccaatctgacaataatgtgttcatcaggtacctgtggattaaatcacatactggcatatttaagctgaatgtcagtctgaaaaataaatgtactatattaactcaaataccactctctgtgtaggtattttgtcatatgtttaagaaaaagctaaagagaatggaaatcctatgacaataactatgacaataactatgacaagtctttcttcaaagtgcatgcagtcttttgcagtacctcattcagccaagtatttgttctctacctcattcagtataaggcagcctttaatttgcttagaaggcaacattagaaggttagagttcagcaggaacatagaattttaaaatgtgacttcaactgaataaatttgaatttctgtagggagtaaagaatcaaaacacctatttaaagactgcaaaatatgataattatttttaaagtaattgattaaacctggtaggttttcccaaaatgaaaaacaatcagttctaaaaccaaagctgatttttagaaaatgtgaaaatgtaaatcaaccctatccataacagattctctaaaactttatcttacagtcactttcaaataactattcaaaaatgtaactgctatattaacgtcttaaaataatttaaaacattttaaaatatgaatactgtagtttaaaacaaagaatctaggggaaggaaaagtagacaaagaaatgccaattccagtccaaagctgtatttgccaagttttcttagaatgacttttaccgatttatgaattcttatacacagaatgcataatggaaatactgatttttgtctaaagtggcattattgactgctgctgtgatgctactataatgtaatacattattaaattgtttcaaggtgctgttttgcctaaaaattttgtgtgtcttgaaaactatagtactgggtattgagaccctgcaaattctcggcatgcttggcatgaggtaatcggtttttattcttacaaaattgtaactatgtaagtgtgtttattaaaagaacacaaactaaaaaagttaacaggaattaaagttgtgggatgaaaaagttacaggataaaaaaatactgtggaaaagtggcaaaaaaaagttgtggaaaaaaagtaaaaaaaaagttttatgaaaagttattttaaaaagttatgaaaaattagttacaggatttaaaaaaagtcatgggataaaaataaaaataaataaaagcaggcccctgtcagcataagcctggagaagtgggtctggagtcttcacccccaccatgtccctacaacccctccccagtcagccctttaccattagggtagcaagacaagacccttgtctaatggagggagacaaacagaccctttaccaccttgaccaaggctgagtccttacatttctggatgatgatgtttgttatttaagagccagaggttggtggagttggtttgtttggaggaggtctgacggccttcttactctcaccaaagcaacttttccctcaggggggctcccatcttcttactcagagaggcagctgaggcgggacagtggagttaactgtagaccaggccagggcacaggctgctggggttggccccccttcccccgtgtacatactgtagctgtgtaacattctgtattgtacctagcggaggttgcagctggcatatgaggaagaggttcttataattattcgcggctgggaaacttatttattgctagcataggagcgaggaaggaggcggggatggggtcatggctccctggtgatgggactcctgtttttttttttttttttgcttttgattttggaataaatggatttagccatactgctcggcctggtatgttcccatttccctcactgggtcctgcagtttgtcccactgaatgaggagccccagagtgtctcagcatgtccagctgggctgttggggaccttccaggcctgttacctgtatgctgcctggtgacacctggtggattttatggggactgccatggcgcctacggagtacactctggccctgacagccaactggttgagaagcctgatctagctgtggcagggaagacagataccagtgcccaagggcactgacttccatccaccccacgtgtcttccattccgtccccctgcctccctctcctgtctgcaccgggtggcctgtctgtccctccagagtgccggctgccccgcaggttccctccaggctgagttcagggccctgcccctagtggccagagctggcttcacagggtaagagccagctaagctccagggactttccaggaaaagtgtcccttgaaaagggtgtgaccttttcactgctcccaacaacaccctaaaaatggcttggccttttccatcccctgagctccatagagaacacagccagcagaggacacattctctgtcatccagaaatgggtttctcagtcaagggacagcaggactggtagagactgtcaggccacacagctgcctgcacagcaccgccatgcttggccagaagggcgggagggatggcgggggctggctgtccacaggccgcgcatgtcccggaagctcactggaggtggtgcactttggaggggcgatgtcaggagacagcttcctcttgctggtctacaagactccacaagcacagcacggggactgattcccagtgctagaggtgaggcagttggccacgtgtatatatgtatatgtgtgtgtgtgtgtgtgtgtgtgtgtgagagagagaatttatagctatttatagaacagggcaggggcataccacagagggggcacaagtttcagcaatggtcacacctggacgtgtcagctcaccgctacaacagactaagtcacagaagaagggggctggctttggagctgggggagccactgtcaagtcacaggacacccgcccaggcaggcttggaaagggaggtctctgagaagagggatctgtttagaggtcgaagtggggcctggggctctcaggatgggatggacttgcctgacccgatcagctggcagttggagagaaagcagagagaaaacgggttagagaaaagccagagctggtgaggcaagtgcagagtatgggtgcgctgcagcagctgtggagggccggggaggggagggcgtaggtgtgggcatggcaaggttcctggaaaagaggggctggaagggaaaggggaggaagatggagggagaagccggagcttcataggtagtgcctggggactgcggcggccctccctaccccacacacgctggcctgtctcatggaacccaggcaatccacccatccacccacagttcagaccaatgccacctccctcgggcttccctcttctgtggtccccatgtcttccaacccactggcccagggccacctcttgcttggagagccccatccaacagccaccagacctgatagagaaggaacactgattgaaccaaaatggtggagctataagggatggctggctggagtgaatgccagaggcccctctgggccatcagaaagcccagggtcctctgagggaccctggggaaggcagggagggcaggtagccggatgccattggccatagacttctaattctaacaggggagcctcaactggttggcggggggctgcaggttacataggtgaggctgggcccttcctgctgggaaaagcagaagagggagactccgcggcaggaaagggaagtgagctctctaggtggagctcagctgggccagcagcactattggctgaatagcacaggcgacccctagaagcaacaggccaaggtgcgtgagcctgctggccagcagtagtgcttcagcaggggccagggaccctgccttcagtcgcacgctagcagctatcatggtacctgggagggagggaagggggctgtgtgtccttccatggcctatgaagtgtgttgtgggatgaccgcgtgtataggactctcaggcttttatcctagatcaccactggattgctgacagatagaggacgtgggaccgtgactatcacccctaatctgcagtggatttggctcttggcactcccaggctgggagctggatacctgccctggcagcatgactcagactgcatgacaggtacggcgtgtccaggatgatgtgcccaggcctctggccgcctgagtccagccccccacacaaccccctccaagctcccagcccctacaccataaaccatgagctctgtgccctctctgatggttccacatctgccaccttgggcatggagcctgttgtaagagcccccaggctcagccatggagaccttgagcagtggcactgagtcccgtggctcacagggagcaaagtgagacagccagcagcacaaggacagaaagaggaaagagcaagtctgcagctccagaagggaggggcagggagcctggctctgaggctccaggtatgccccctgtgtggagctggggcagcggggcaggcagaccattcatgcagcaggcagtgaggcatgtacctaccatggctgatgctcctcaggggccactgatagtgattctgaaagacagcttcaaatcacatggcaggtcacatgcatgggtggggcaggcctgggggtgggggacacacacacgcacatgccggagtgtgcacacacatgctgtgaggccccacggcccacatgcacacgctaacacacatgcccacaaacaacacgcatacgtcgccctccccgccacctcccaatgcccagcaccctcaccggccggcacgtgccacatggatctggggcgtgcagccacacggcacactgaagcacatgcgtgggcagagtcacaacacagatgctcacctgcacacagaggcatttgcaccagctccctgcacactcgtgcctggcgtgctcagaggaccacccatgctgctcacggagacagggcttgctcactaatgtccggctgtcatttctccacctcagagccttccatggctccctactgcctacagcgttgaatcccaacaagtcatactctttggactttgaaggttctccaccctgtgccccaccctccccacagagctcttcctcattctgtctctgttccctgctttggccagtggctatccgcgatgtgacccacactacacctctgcccacactgcagctctttacccagttaccctccagttcctcaccatgtatgcctacctcagtcatgccccagactgcattgaagccaggctgccttgaagaagctctcccagactgcccttttccccaaggcagggtcatgatttaccaaaggtttcgtgtgtgttagcaagactggagtcggagcaggcatcaaactttacatcccatatgtcacacctcaccatagatctgggtgccaaatagcctgaagagtctgaactcacgctggaagttagcaaagtgctcctacagccgcatctgcagttaacatagtatccctatggccactgtctcccttgatccccacagccatcctaggagaaaggcagaacgtcatttgctagaagggatgctgaggctctgggagggaaagggacttgcctaaagccccagggtgaagcagcatctctggactctcatagacagcctagagctgccagcattcccttaggatctgtgccctcaggcctggcttaattttttcctctgcaaagagccatctgtagggccagaggctggcaaagcctgactcattactggatgccagttcctttgcctgactttcagtgatttctaccttaccctggggttttatgttgcttgtctcaacactgtcacttctcattcctccacaagttgaattgctcactccagccacttgaagcatgctcttcttaacacagttagctctaggcacatggttggtgctaaaaaggaaaaaaaaaagaagagcattatgtcaatttcattgattaacaaaagcgatggctccactgcaaagcaaagttgatactcctgggcctctgagttcaagagccttttagacaaatggctctgagctaaaacatgatcatgcatgcatatgcatctgtcttggtctgatgagataatctggatacttgcttgttatccttgagcattttcctgcctcattaatgtatgtgtagccaccacaataataatcatagctaataatggctacagctgagggctttcctgaaccaggcagtggttttaaaaactttaacccctaaagctgaggactttcctaagctagatagtggctttgaaaactttaaagttttcacatagactgtcattgaataatttctgtttttcagatcaagaaactgagacttactatcatatttgggattaagctaaaaaaaaaaaaaaaagaaaagaaacagaggctgaacgctgtcaagtatttcacagccagcaggaaatcggaacttgaacccaggcagtctagccctgggatcctttccccttacccattatccagtgttggctacacaaaactaatgagtacatattttcaactatagtttaagtgggtgacatatttttcactatattttatgtaggtgactttcagtttgggggtattctacttacacaatctattgagctggatattaactgagagcaaacagaaactaatgaactctgaaaaacataaaacatgagcaacatgacgtcactgcaagagacaaaacagcacatagccttcttgtgactgtattttgctgacagtccatgagctgatagcctgaactcagcagtgctgttcccttgggagacacacacacacacacacacacacacacacacacacacacgagttggtggttttctgccccccacccccaccccaacacacacacgagttggtggttgtgctgcccggagcctccagtccgcgagtgtgaagaacggaccagatgggtccagcagtgctgggtcaaggcgaggagggggcagccggaagcgcgcgcatgctctggactcctgcagccgccgaaacgggtgcgcagggggcgcgcgggttgaggggagaggggcgacgggtgtgaggggcgagagggacgggagcggggtaggggcagccctttcccaggcggtagcggggactgtggtgctgttgcccttttaagctgcggcttgacaggagcagcgtctcctgtcggtggagtctgttacaaggggagcagccgcccaggccgccacacagctccccgcagaggcctcggtgccccttgccattttccagccctactccgaatagagttgaggcatcagggagaggcggagctgggagagcgccgccgagaggtcccgcgggtggttgcggccgtgacagcggctcccgacgggctcaccttccgcgcccctcccgccagaggtgagagtaaaatgtccgtgtgagggttcaaggccaagctgaggttgttggcctctatcttccacaagaaccaggagccgccgccgcagctcacgctccactgcaacatcacggtgaggcgcccagtggcggcctcacggggcagggcgagggcggagaggaggcgcccagagtcccgggacaaaggggagcctgcccgggagaggccccggttccccaggcggggcgagcgcgcccctttctcccgcgtctggcccgccccgctgtgtgaggcttgcgtgggaggagggggagggcgcgtctctctggctccttgccgcggggctggcttgggggctgccggcacctctcgccccagtcgctgcgccctgaggtgggagcccgcgtcgcccgcagaccttttggggcccatgatcgccctcagtcagctagcctgctcccctggaccgcgacggggcgtggcagggcggctcccgctgttgtttgagcccagtgagggaaggggaaaggcctttaagattttcggttttttggccgggcgcagtgctcattcctgtaatcccagcactatgggagactgaggcagctggatctcctgaggtcaggagttctagaccagcctggccaacatggtaaaaccctgtctctactaaaaatacaaaaattagccgggcatggtggcaggcgcttcttgagatggagtctcactctgtcgcccaggctggagtgcagtggagcgatctcggcatactgcagcctccatctcttgacagtctgtcggttcaagcgattctcctgcctcagcctcccgagcagctgggattacgggcgcccgccaccacgcctggctaagttttgtgttgtttagtagagatggggtttcatcatgttggccaggctggtctcgaactcctgacctcaaatgacccatctctgcctcccagagttctgggattacaggcctgagccaccgcgcccagatccaaggcccttaagcttaaatgcctcgttcttcagtcaggttttccttgttcccgcatgttcagccaatcgtgtttaaggagaaactaacaatgaaaacggactcgttgatggaggaaaagttggaatgcagcctctggtgctgtttgagcgatccctctaccccgggtcgctgctgtgttctggaaaggcgcattgtaccctggatgcagcaggtaagagtcctgtccaggtgctctgcccgcttttcctttcaggcttctgtatcagctgtttttcccctgtagaatgtgcccctgacagccaccccctaaccctacccaatttgtctttacgtgtctgaccatcaaggctcttctgggtcatatttaattcatgctgatatttccccttcctcccctctttagtcctatttttgctttggttatgttatgctatattctgtaaggctttaaaaaaatttttatggtggcaggggagaatgttttataattatgctttgtgctttttatcttccactcaataaatgcttggtaaatatttgttttattgaatgtatgaccctattctagctatattgtgcttgaacaaaaaccttaactgcctagtaagttaactgctaagaatttgtcagaagtgcagacataacatcaagaacttgtcatggatagtgcaaaaacgtcacttaagggcttggtggaagcctgtaaattgacttcctatgaaagagagtgtaagaagtgaaaatgtaaagcatgactggagagccagagtgatgaagccagggtccctttctccagatcctttgtaacagtgttatgtgatctcttctagaagatcgttctgaaagataatgccaactcggaacctaggaaaccatccagtgggtttctgcagcttaggtgtttcaaatcctcatcagcacgtttgttttctctgcctcagtttgcttacaatgatgttctcagtagctacaattgctgtctttgaatacgtaagcatttttttttaggtgacagggatatatgtgcatttttattttaccaagtgttagaattttgactctgcttttgtgggctctgggttagctacttggttgttgtaaaatgattagcagggaaagctgtgtgtgtgtgtgtatgtgtgtgtgttataagtttcttttgttgtcagaggacttagaattttattttatatggtaattctgtcaatttactttattctccaccccacatttattgaacagcaaattatgaaagtaatgtgtcccataagcagccttcagaagaattacaactgctgtatatctgaaattcttttttttattttttattttgagatggagtctcactctatcacccaagctggagtacagtggtgcaatcttggctcactggaacctctgctgcccaggttcaagcaattctcctgcctcagcctcctgagtggctgggattacaggcacctgccaccacacctggctaatttttgtagctttagtagagacaggtttcaccatgttggccaggctggtcttgaattcctgacctcgtgatctgcctgcctcagcctcccaaagtgctgggattacaggtgtgagctaccgcacctggctgaactttcaaggagaagtttgtgcatcagttttcaaaaaattatgatatcaaaagatagctgtgccctacatttggaaagatacaaaaactgaacatactggcaggcagttttgcttgctggtgcttgagatagaggcacacattggtctcagtggaattatggagaaaaatagataaagttatttctaaataagaccaaaaaatccttttcttaagcagtgacaggtaaagaggttgtcttggctaaccttgaattgtgttgcccttgattgagacagttttatggtgggatggtagtggtgataaacttgctggaaatttgtctgcttatagtaacctttgtggtagctgtcacagacaacttcatcctcacaggccttgaaattagtataaaactaacagaatggaggagaaacaaaggatctgaataattagatgcttagataattgttctgtgttttcattactggtgaaaaagagcagtattagaagcacttacacattctatagaaggaacactgcctgaatttatattgcgatttttgagcaccattaactgtataaaaacaggcatattgtaggtaatattttaaagacaaacagaaaatttatcttttcaagatggatctaaaacttatcaaaattacaaaatttaaaacgtgattgaaaaatattaatgcataggtttaaatattggtcattttaaatgtctttcaaaatagattgtctcttaaatattcaactgaacaaactttgaacatgttgtagagtttgtgccgaaggttaaatttcctggggtgatggatattttgtaatatggaaaacaaaaccttcttattttaagaaatttagaaaacttttaggcaaaactagaaaatattacctatgtaattctaccactcagaaggtgccactgtcagaaatttgtatctttccagtcatctgctcacctcttttctcctgtgcttgtgtatgtttcctctcccttaaaaatcagatatttgtttgtaatctgctttttcactcaacagtattgtagatccatgttataacttactcctctacattgccttcagttattgtgtgctttctgttggatgactttaccatgtagtcagtcatgttttctggtactgaatacatacgggtatgtgtgtgtgtgcgtgcgcgtgtgtgtgcgtatttttttgtaacttaactaatgctttagacatcagtaggtagacgtaaatccttgaaaccttccacgtggtgactttcagttctcattgctgaatttgtttccagagatggaagaaattatattgtatgggaactttttttttcttttttctttttttttttttttgagatgaagtcttgttcttgtcacccaggctggagtgcaatggcgtgatctcactgcaacctccacctcctgggttcaagcaattctcctgcctcagcctcccgagtagctgagattacaggcgcatgccaccatgcctggctaatttttgtatttttagtagaaacggagtttcaccatgttggccaggctggtcttgaactcctgacctcaggtgatttgcccacttcagcctcccaaagtgttgggaatacaggtgtgagccgctgtgcccagcctttttttcatctcagtaccagcttttatttatcagattggtaaaaatgttagaaagtgtgcaatgaaatgggcattcttacagtcatggcaaaaaatataattatctttgactttctagaaagtagtttggctttctagaaacttgtttgaattctccctgtttaggcaggatgaattctcactaccccaaggtggccaaccttgtccctgtgattccatctctcccagaaagagaggtctagtctcagggaaaacccagatttgtttggcttagcccatctgacagctaatcactggaaatggggtaggctggtagaatgctttggtcaggttttgtgttgagagagaggtggaaagatgggagggaggtagcaaaacttgcctcagtggaactatgtaagttaatatagaatggcaaagggatgtttcttccaaggaagaaattctagagaaggaagaaagtggaggggaaggcagcagttctccaagttttggggtcaggattcctttacactcttaaaaatacattgaggtcccaaggagctttggtttatgtagggtatatctattggtatttatcactagaaattaaatcagaaatatttaaaatattgtttaaaagctcaccacatattgttataaatgcttttatgaaaagaaaatttctaaacccaaagtagtacagtcttacatcttttgcaaattattttgatgtttgatatgtcatttgcatgatgtttgatatgtcattagcaaattgatatgtcagtttgcttctgcattcaatttattgtgtgatattttcttgaaaaaatgtgaacaaaggccaatctcatacagataaccattttagatcattgtggatatatatatatttttcgagatgaggtcttgccctgttgcccaggctggaaggtagtggtatgatcatagctcactgcagcctcagtctccagggactcaggtgatcctcccacctcagcctccagagtagctgggactacaggtgtgtaccaccatacttggctaactttttgtattttttgtagagacagggttttgccatgttgcctaggcttcttttttgatactccatcaaatcttggtttttcttgaactttggatcttccacccttgcatgatattacaacatcgtgcattggtcacttataaaacagtggttcactaagatcttctacatgttgatacatttgtacagtatcaaaatacattcatcagtaccaccatcaatctcatcagaatacttttggaaagcgatggtgggcataagttttctaaaattctaattttttgttcaaaagcttgaattttattagtaattttgttattgaattttattatagcctgtctgttgttttccttgaaatgacagaatctcatgttttgagaaaatatctgccagaaatgcgagttaaaataacattttttgtcagtcagcctttcaagtaaaaatggtattccattaaagtggttaattcacttcatgacttagccactcaagggtttttcctcaggcagcctgtaggaatgctcatgtatacttcccatttcatcacttgaaatattaaaaagatatattcaatgatttagatatagtaaaatattcactgcttcatcatagacattcttttttttttttttaattttcgagacagggccttgttctgtcacccaggctggagtgcagtagcgtgatcacagctcactgcagcctcaactttctgggttcagtcaatcctcctgcctcagccttccaagacgctgggactacaggcatgcagccactgtgttcagctaatttttgtattttttgtaaagatgaggtttcaccaggttgcccaggcaggtcttgaactcccgggctcaagggatccccctgcctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaagtattttttcaggtatttcagcaaaaattaaatacctaggaataaacttagatgtgcaggacttttatcaaggacaggacaaaattttgctgagtggaatgaaagatttgcattctatgttcctggatgagcagatttcatgttataaatatgttagttatcaccatgtcttcatattaatttgtaaatgtaatttctgctgggcacagtggctcatacctgtaatccaaacagtttgggaagctgaggcgggtagatgacaattagctgggtgtctgtggcacacacttgtatttccaactacttctgaggctgaggtgggaggagcacttgagcctgggaggcagaggttgcagtgagccgagatcatgcctctgaactccagcctaggtgacagagtgagaccctgtctcaaaaaaaaaaaaaaaaaaaaaaaaaaactagaaaagtgtgtgtgtatatatatatatttcatattttataaatatttatatatataaattgtatatatacattttatattttatatatagtgtgtgtgtattatatatatacacacacacacacaaatttcagtacaaattctggcagatttatttttgacacttgacaaaacgactctaaaatttgtttagaagaataagtaataaaaattaataaagtatagacgctttcaaccagatagtaaataaaatattgtggactatccctgggccggacagataaaggcaatggaagtttagaaccagagtcatgcaaacgagaatttagtataaggaaaaggtggtattttaacttaatactgaaaagatagattattctgtaaatggttttaggagaactatttgaggaagtctgagtcttaactccaatttttgtcaaaataagttagttggtttaaacacatctattcttaaaaattagaacagaagaatattggtttgaagatattttaagagttaaggctgaggctgggcacagtggttcacgcctgtaatcccagcactttgcgaggccaaggtgggaggattgcttgagcccaggagtttgagatcagcctgggcaacatagcaagactctttctctctctctctctctcgatatagatatacatataaatatacgtatacaaatagaaaaaaaaaagagttaagttttatatggagagccatgaagataagaggtaaaaattaaaggcttgatggacacatgtttacatctccatcaagggggttgatgggaaagaatgatagacatagctccattactgctacctccttttaggaagttgcttctgaacatctaaagatatcagttttataatagaaatgagttatttttcagtgtctaaaacaccacatgagatacatacatacatgcatacatacataaatatgttcataaagttaaatgaaataggatataaaattgggcctagtgtttaaaaggtaaatatatttacatgaaggagaaaacaactcacctcccactcttagagcctctgccagtttatcatagcctagtttcttgagagaataagctacatgtcttcaccttttttcactgagctcattatactctggattctgccttcatcgttgcactaaaatttatctcctagttgtcaaatccagtggctcccctcttagtccccaaattgacccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgaatagtacaacacaattaaaaaaaaaaaaaactgtgtgtctgctgcaccaggacctgtgataattgggtataaaagacaaaaaagacatgtccctgtcctctgggaagggacatgataatcaaatgagacttctgtcggattcttttctcctgttttgatcttatcaccctttcttggtctcctccgatctcttcttccttgtcctacttcttctcttctcattctgtgctttctctgagtaatctttgactcccattacttaagtcatgacctgtgttccagggactcctaaatttgtattcatctccagagtttcaaacccatatatctgtctgtatatcatatatttagggaatctcacttggagtgacatgggtgttcaaaatgatgatatttaaattttcacgtatccatctcctagcactctatctagtcacatatgcctaaacctgggaactgtcttaatattcttttatatacacctgttctgacctcccccccaaactagtaaatttctaagacctgtccttctgaatgtctcttacaattttccctgtgatctcagtttcttcctcccatccctcaaatgctttgtgtgtgtgtgtgtggtgggggaagagagtaaaattgaaatttgtggaaaacgtactagcctgtctgtctgtctttcgaggtgaagtctccctcttgtccccctggctggagtgcaatggcacaatcttggcttactgcaacttccatctcctgggttcaagcaattctcctgcctcagcctcctgagtagctgggattacaggcacctgccaccatgcccagctaatttttgtgtttttagtagagatggggtttcatcatgttggccaggctggtctcgaactcctgacctcaggtgatccacccgccttggcctcccaaattgctgggattacaggtgtgagccaccatgcctggccactaccctgtcttgttgcttggtatgactccactaccctgctgcctctctccccgtacagcagcataatttaggaatcagagagactgaggaggatatatattatttaggtgcaccggcccagtcagattaacatctaaaggactgagccctgaacaaagagtcaggttaccttttaagcattttgtgtcggtcattatgccgacaaggtgtccgcactaagttcagtatcagtatggtgacctcctgggaacaggtcatcggcttgcctaaggatgggagaactggcccaggtcagaaagggagcaggtcagaattcctgcaccaatcggtagtgggactgtgcctgggcaatatagcaagatcttggttcttaaaattcaaaataaagaacagctcattcccctctggggaggggctggctcaaggttacacagtgagtgtgggggcagaggcgggcccactgtacctcccttgttgggttgtctgaggacccctctggccaccccccacaggagatggaggaggacatctggacagtgagcaggaggcgcttcggcccatgccgaacatcccaggggacctggagagccgggaggccatggtgagcctgactttccctgcccctactttgccaccttcctctgtggtccctccgaaacccccttatgttcttggtttccccgccttctgacttctgtggactttctctgcttctgggagccagtggtcagacaccatttcacctgtgaccaacaggtgcactctgtgaggcccgaaaggaaggggctatgctccatctgcctgccccagttgttatgtgtatacccctacaagaatactcacctcttgtcttcaggtggcatttttcaactccgctggagccaatgcccaggaggaacaaagggtgtgctgccagcccctggctcacccagtggcctcgtcccagaaaaagccagaggtagcggccccagccccagagagtgggggtgagtctgtgtttggggagacccaccgggccctgcagggggccatggagaagctgcaggtgagtaggtcctggcatcggccaacaaggggggcgggggggcaggacaaggcaggtgactcctgacatgtgaccccattattttggctccacagcgactttatggaaggagaaggtggacctgaaggagcgggtagagaaactagagcttcaattcatccacctctcaggacagacagacaccatagggagtgagaggctagggcaccgctggggggagctgccaggccgtccgaggggccccagcatctgagccatgtcctcctgcaggaaagtacatcagccagggggcagtgtcagagacgcagcactgggagaggaggacatcgtcaggctggcccaggaccaggaggagatgaaggtagggtgtgcaacatctcggtgggggagggtgggggtgggtgtgaacgtgcgtgctggcaccggcatggcagctaacaccccttcctccaggtgaacctgcaggagctgcggggcaggtgttgcagcttgtgggagaccacaaggaggggcatggcaaattctgaccattgcccagaaccctgctgatgagcccactctaggagccccaatagcccaggagcttgggtgtgctgacgagcagggtggtgagtagagccctcaggcggggtgggcaggcaggagcaggggaggctcacactgtgctcagattcccaccccccctccctctctctgaagatctttgtgaggtgagcctcactgatagcgtggaggctgcaccaggagaggacagggagggttctccccacgacaaccccactgcacagcagatccagcagctgcttcctgtaatgcaggactccccaggagcacccaggcatgggcagcaacccctgcatgccattctttttgggctcccaagaacagggagataaacaccaccatcatctgagagccgggaaggggaaggcgtaggtgtgggcgtggcaaggttcctggaaaagaggggctggaagggaaaggggaggaagatggagagagaagctagagcttcataggtagtgcctgggggctgtggcggtcctccccaccccacacacactggcctctctcatggcacccaggcagtccacccacagttcagaccaatgctcaactcccccggcttccctcttctgtggtcaccccatcttccaacccactggcccagggccacctcttgcttggggagccccacccaacagccaccaagcctgacagaaggaacactgcttgaaccaaaatggtgaagctgtaagggatggcgggctggagtgagcgccagaggcccctctctgggcagtcagaaagcccagggtccactgaagggaccctggggaaggcagggagggcaggtagctagatgccactgcccatagacttataagtctaagaggggaacctcaactggttggcggggggctgcaggttgcataggtgaggctgggcccttcctgctgggaaaagcagaagagggagactccgtggcaggaaaggcaggtgggctcgctaggcggagctcagctgggccagcaagcactgtggtctccttggctgaatagcacaggtgacccctaggagcaacaggccaaggtccgtgagcctgctggctggcagtagtgcttcagtagtgctggccagggacccagccttcagtcacatgctagcagctgtgatggtacctgggagggagggaagggggctgtgtgtccttgcatggcctatgaagtgtgttgtgggataaccgtgtgtataggactctcaggcttttatcctagatcaccactggattgctgacagatagaggacgtgggaccgtgactatcacccctaatctgcagtggatttggctctcggcactcccaggctgggagctggatacctgccctggcagcatgactcagactgcatgacaggtacggcgtgcccaggatgatgtgcccaggcctctggccgcctgagtccagccccccacacaaccccctccaagctcccagcccctacaccataaaccatgagctctgtgccctctctgatggttccacatctgccaccttcggcatggagcctgttgtaagagcccccaggctcagccatggagaccttgagcagtggcactgagtcctgtggctggcagggagggaagtgagacagccagcagcacaaggacagaaagaggaaagagcaagtctgcagctctagaagggaggggcaggcagcctggctctgaggctccaggtatgccccctgtgtggagctggggcagcggggcgggcagaccattcatgcagcaggcagtgaggcatgtacctaccatggctgatgctcctcaggggccactgatagtgattctgaaagacagcatcaaatcacatggcaggtcccatgcatgggtggggcaggcctgggggtggcagacacacgcacatgccagattgtgcacacacatgctgtgaggccccacggcccgcatgcacactctaacacatgcccacaaacaacacgcatacgtcgccctctccgccacctcccggtgcccaacaccctcaccagccggcacgtgccgcatggatctggggcgtgcagccactcggcacactgaagcacatgcgtgggcagagtcacaacacagatgctcacctgcacacagaggcatttgcaccagctccctgcacactcgtgcctggcgtgctcagaggaccacccatcctgctcagggagacagggcttgctcactaatgtccggctgtcatttctccacctaagagccttccatggctccctactgcctacagcgttgaatcccaacaagtcatactctttggactttgaaggttctccaccctgtgccccaccctccccacagagctcttcctcattctgtctctgttccctgctttggccagtggctatcctcaatgtgacccacactacacctctgcccacactgcagctctttacccagttaccctccagttcctcacaacgtatgcctatctcagtcatgccccggactgcattgaagccagactgcccttttccccaaggcagggtcatgatttgccaaaggtttcgtgtgtgtgttagcaagactggagtcagagcaggcatcaaactttacatcccatatgtcacacctcaccatagacctgggtgccaaatagcctgaagagtctgaactcacgttggcagttagcaaagtgctcctacagccgcatctgcggttaacatagcatccctatggccactgtctcccttgatccccacagccatcctaggagaaaggcagaatgtcataatttgctaaaagggatgctgaggctctgggagggaaagggacttgcctaaagccccagggtgaagcagcatctctggactcccagtccagtgatcttgcccaatactttgctgcttgcctatacccctctaacttggtcaacagcacatcacagggcaagccccaatccctgcttcatttttatatatgggcgctggtcccacagccccactctccagccatttggaaacaaaaacagatgctattgttcttccttagagaacgtggccagtggagacggcacactggaaatcagagtgaatgttcttgaaagagggtcacgggtcaacaaggcccagccaaaggatgcagtagaaccattttccttagaaatctttgggagtgaagtaggcttcagccactcccatccctgccctcgcagctaccactaccccattagtttagacagggtcgggcggggaggggtgtggagaagaaatgagcttgcctgtggcccccaggctccctctgtcctagctcaggtctgggtgccattctttacactcgtgtgctcgctcacgcacacatcacacaccttgctggtcacacagtcacagactcgcctctgctcctgtggtccagtggccggacaccccctgggatggctcaaaggagtcaggacttggaagtggggacatcagggtagctgaaggaaatccacacacccagagcatctcggagttcagactctcagacctgaagtaggcgcccccgggactgggctaggagttggacggaatggaggatggaggacagcgagaagaaaggaagagaaatgcaaagtgtgggcagccgccaagagtgaaaatagagggaagtgtcatgcaagtgctggacagaaggcggcaggtgggacgagccccacagccccctcctcaaaaacgaccacctccaggactcagtgatccctggggggcaggctctgccagccctcggccacacgtggctccggcacccatggtcccagtgccttggatggagacggccagttctggcggccagatgtggtgctctggaatccagtcccatttccttcctggccacgcctgtccagcggcctcttcagccgcattcagcccctacttacctggggaccccggctggggcacgagagtaccaggggggtagggcccaaagggatcaggggaagcctctggcctggagggtatggggcacgcttccccaagggcggacccggcaggaggaagcccaggagctgggtcctgccgcccaggagctgggccctgccacccaggccgggctagggacatggcagggcctgggcatcctgacgctggacttgggcgacctgggaggcacagggaggggagagatgggcgaccccgccccagcgcagtgccggccacaccccaaggcggttgccagagcttaagccccgcccccagcagcgagaacatcccagctccacaccccccccccgcagccagtgctccttgtcaagctccccccgtcactccaggtgggagccaccccggtgagggggtgtgccacttgcccccagggcactcctctgggcatcccgggtgggggattttggggccgtggggggcagtctttggtacctgtgttcgtcagggatgctctgacaaccaggtgtcgtccacgggcgggggcatgggcatggtgacagtggtcctgttgatgtcaccgatgatgctgagcgcctccttcagcgcgtggtgcatgtgcagcatctcgtcgtgctgctgtgcctgctctgccaactcctccatcagtgtgttctggttcccacatgagtacatattggccagcggctccgagatgatgaactccggggtctgagagtgggcaaacagggaagaaggttgggacctggtgcctgtgccgccctggctgccttgctgggcccttctgggactgtgcgctggacttggagccccttggagtatggcttttcacacgggcttctataccgcttcgactggaagatccacctccccactgccttttctcactcagatggggacaccgaggtccagaggaaaagacacctgtcaaatgtcacagatctgggaggggacttaagacttatcatgccaagaggacacctgtctactcagtttttttttggtggggcggggggcggtgatagggtctcgctctgtcaccaggctggagtacagtgatgactgctcactgcagcctccacctcctgggctcaaagtgatcctccaacgtcagcctctcgagtagctaggactacaggcacatgccaccaccaagcccagctatttttaaaatttttgtgtggagacaaggtctcactatgtggcccaggctggtctcgaactcctgggctcaagtgatcctcctgcctcggcctccaggagtgggagttggagttgatgcctggatacaggagctctgtgggtgggagtgagacaaaacacagggtcctgagctctggggaccaagcaatgtcctctggtgaaaaaaatcctggacttgctggcagaagatttgcctcttactcgccatgtgctctgaatacatttacctgccctctgggagcttcagttttcttatctgaaaaatgaggacacctgaccccttccctgcccagttcagtgttgtgggacagggttgctgtcaagacaatacccagtcctgccctcctccctgagtgggccaggtagcccatgtagcctcttcccagctttcctgggtggcactgccagcctggtgcccattcaatctagtccttcatcttgctggagcatggggaagctctgagtaacatgggactatagagtgcaagagggttgctgatggtctgggtcctgtgccctcctcattcctgggcattcttgacaaaggctcccagcaactgagggtacgcagcagctgtagacaccagcctgatgaatatctcattgtgggaagggcaccatagcaggagtggagctccagggaaatacagaaccgaggtctgggaggtgctgatgtgagaggcccaagaaacctcggctttgcacttgctgagtaccatctgcacctctcaggagggagagcgccaggctcaggaggtccttgccgaagcaagggagcttgaaaagggggctggggtgggctctgccattttcaagggctgacagggatcccctctggaggtacttggggcagtgctgcgtgccgtggctcctgagtgacagagtcagctctgcgccccacaagaccgctccctgccgagaactcactgtgatcatgtgctgggtccagatgctcacgcagcctcctgatgggagcatcaggtgtgctgcctgcccagggcggcccacaagagtctgccctgccctgccctgctctgctatggaacaactcccattctgcctttggggagaggtgttcatttaaaccatgagtgggctggcccccatggcacagttaccacagagagtctgccactacccatggctgagagctctagttcttctctgaagccaccaggacagatgaacagtggcttcccccttttggccgactcagctgcctttcatcagctcatctgctcctaggatccactcttcctctggctggcacctgatctgagcccgaggctcacacctctgcccacaggccccagcagctgcttcacctccgactccatcccccaccaagcactgcccctcaccagctgctggggtgccactagtgcccctacatggttctccctctccagacccttgggtccagctctagcttccttcgggaagccacaccccaagaccccagccctgctctggggccctgtatccccgacttcctgcattcttctccctccttctgggaacatgaacttgccctgccagcctgatgactcctagagggcaggacaccaggtcctggaccatggcaggcctgggagtgtctgctgccggtgatgctggagctggtgcccatgtccacatgatgtccatggcacagtggccacctgaggctgggcgcatctgagtggtggctgcagagtggggcccttacctctgcctgagtgaagttcaccaggtcctcccctgtgctgtcatgctgggcgtggaagagccggcctagctggaggccccgcaccacatggtagagcaggagctgggggtcggtgcctgctggctctgaggctctggctgctgagtggctggacggactctgccagaggcaaaaggggccatcagcctttgtgatccaggccgaggcctgtggctgcagagaggcagtgtgaccctggcatgccaccctcagctctgccccagccccccgcacccaggaacgcccacaatcagcacacccacctgggcagtcagtgtccggctgccctccagcgagtgaagcacttgcttctgggccgtcactcagaagctaagtgtctggaggaagtatgttcaccgtcagagaggccaaagtggatgcctccgtccagggcccctggggacaagggtgttgggtccagctggcctgaactggctccccacctcagggtgcccccgtgggcagcagaaacctggggctcggccctcagcacccacctctgtgtgagaacagcacgagcccaccatccagctgggtctgcatgaagctgcgcacctcagtgcccggcaccgcccactgcactacccacccattgctgggctgcttaatggtgtacaccaggtccttgggcccagagtaaccatccatgctcctcagagcctctgtagggatgggcacggtggccccctcccacatctggggacacaggcctgtgaaggttctgccctgccacacttacccaccccttcctccccggccctgggctgccaccagggctccaaccccactgaggctcaggccctcaggtggcatcaaggctggcgctgctgcggctcccctgcacaaatggcctccctgcattcaccttccctgtcaccccagggaaggccaccctccaggcccagcatccctgctcttcatctgtcctagtcctgtgtgtccctcaagaccagcttgtgtacccaacccaggaaggccctagctcttaccgtcaccaagttctcacccccagaaacccccagcgctgaccaacagtgctccttaatctagctcactggtggggcagcagtctcctttcagaccctccatgtgtgcctggcaggggctgggcacaggtgggaacagtgattttagaaacgagcactccttccagctaagggaggggtgggaggcgcagagagctgaagcctgatggttggcactgtcctgcagcacagaagcagtgctgggatgggcccaggtgcttccagagcagttacgggccctcctcgtgttgggcaaagggggccccttttcaggcctcccactagcaagcagaacaggcacccgttcctgaggtcctggtaccactcttgctgggtcaattacttgtgggcagtgctgcagtgggactcacatgcccagaaaacagccctctggcattcctgggcttcctcccctggccgcagggagccctcaggccgagccttggcaagaggggccatactgtgggaggcagggccccatcactgggctcccagaacaaacacgggtagatggcaccacctggtggccgcactgccacacagccatcccagcctgtggttccagggtgctgtgtcccactcttctgtggcgtccgcaccatgaggccaccccctacaggcacatcctagaccaccaaagccccccggtgccccatgtcagagacagcccaagtcagccctcttgcggaaccttcagtggcttctgctgactggggaggacgcgccccagaagctggggttcaaagccctgccacgtgggcttagtaaagccatgccctttctgttccaccagaactacttttgcaatcatggagaagttccatcccatctctgggcctcaacttccacctttgccaaatgggggccctgctctgctgtggacaaggggcaggagtttgggaagccaagctgaggcctccacttgctggggtgaaggtgggaagcttaacggtcccaccctgacgccagcccttaagggcttgtaagtgattctttcaggtgttctggtcctaagccacaggagaaggaacagcagagccacccatggctgctcagaagtctgcctaccgtacttgcaaatgtccaataacaaaacctcccacctgtgttctatttcagcacaatctcacatctctccttccaacaactgcgtgaggcacacagtagtgtcctcattttgcagaggaggaaactgaggctcagagggggggagatctgtgccgggaagtaggggacattggcctctttctcaaagcagacatggggggtggtcccaggaatatgctcacctgcaggcctgagtttgtatgaggtcgggggttggccattgacaggcaggatggtgacagtgaaggccacaggatggctctggcggtccatctcagaggcattagccatcaggacaaaaccgtcagtgtcttgctcccatcgtgcaggtactggatcagatgctcttccacctaggggcaggcccagggctggcagtcaggccccagcagtacccttcatgttctgcctttgggtgcaggaagagactgacccttttagggcctcagcttccattggtggaaaatggggaccataagttctggttcccagaggagttgtgaggaagaaaggggatattttattttattttgagacagagtctctcgctctgttgcccaggctggagtgcagtggtgtgatctcggctcactgcaacctctgcctcccagattcaagcgattctcctgcctcagcctcctgagtagctgggactacaggtgcgggccaccacacccggctaattttttgtatttttagtagaaacagggtttcaccgtgttagccaggatggtcttgatctcctgacctcctgatctgcccacctcggcctcccaaagtcctggaattacaggcatgagccacagcgcccagcccgagatacagcatctaaagcataggtctttctgaaatgtgactccctgtctcctctctgtataacccctggactgggagtccccggggctccctccactctgcccccagagctgggctgcagcccctgggcctctctcacagccgtacctctctccagcagaaggtgctgagggtcctggcttgaggcccatcctccttctgcagggccccatgccggggtggctccagcacctgcaggccaaggcccgggagagtggggaagtaggacctggcaacgcggagcagtggaggggccagggtgcagctgcgactgtgccccctctactgctgaagttttgtgcccccagtggggatgacagcaggcagcacctccagctccacgtgacgtcctcaaggggagcacccaggccgaggccacatccagcgagaaggcatggctccgggcctcagggcgggagtgcaggtagaggatcctgcctgtgtccactgcctcttgggagaagctctgcacggggtccaggctgggtggctcatctgccaagatgccacgcagcaccatcaccaggtagccggcactcggtgggctcttcactgagaaaacgatgtctgctggcggcactgcctcctgggctacctggttaacagaggtcatgaggactcacaagggaatgcagaggggtctcagaggggcccactgtggccctaagcagccagaacagccttgatcttgctccacttatttccccagataccactgctcatttagtgacacacacacatgtgggttcacacacacagcagccagacatgcagctggtcacattttttgtttttttgagacagggtctcactctgtcacccaggctggagtgctgtggtgtgatcacagctccctgcagcctcaacgtcctaggctcaagggctcagcctcccaagtagctgggaccacagtcatgtgccaccatgcctggctaatttttaaatgttttgtgtagagatggggtttcactgggttgccccagctggtcacatgttaatacccaccccacacatggttacggggtgtcggtcaacagcttgagatgcactccctcagggaggtgcataatcacatgtccccagactcagtgacacagacatatgagttcatcagatgctgacgcagtcacacaggtacaggtacacatgcgtgtgtgcacacgcacacaggccccctgctcaggatctgttcaggcctgtggctggtttgctggcagcatcctccccaacccctgctattaccacccaggaccatcagagggtgccctgccccaccccaccccacccctcctagaggcacaggcacccccagcacaggccctacagagctcacaccccaaaggccacatgggctccctcacctgatgggccatccacaagaggctaaactgcctccaaactcacattcctgttttgtgccttcggccggaatgttccttttgcgtggaataccactccccattctctgctcctaatggcctgtactcttcagagcccggcccaaacactgcctcctcccatgaggccttcctgatgccagatctgctggctcaccatgggccccaagctccagatgcagaccagaagggtctccgaaataagcagtgtggaagagtaaggctgagagcgggcaaggactggcctgaggtcacagggcatgtcagatctctggaaggcccgtggctgctctgtggggttcctgggtgagcagaagcccttgacagaccctcctggtcctggtctgggctctgagaagagagcggggtacacaggggtctgagaggcagcggcctgtctccacggccagcaatcccaaaagttcaggacccgtgatgccctcccagggaactgactgcaatgcagattctcgggctccacttcagagattctgtagggctgggtggcgtccaggaatctgcatgctcagccatgccatggacatgagtggacaccagctctagaggcacacaccactcccaggaggatgggtgtacagcaagctccccagaaactcttgggaacacaacatatatgggagcacatctgaggcacgtgcacacacacaagctgggaccaccacaggtacagcccaagtcacatgtgttcccggcatggaggctgggaggaaggccctctacctggtccacaccccgctcaccacctccagctcctcacctccagctggtcccttctgatctcagctgcctctccctggaagatgtagatctccttgtgctaggccagcttcagtggggctactgggccctctagggcaatggtcacttgtagggtggcatctgtgtgcactggtcccacatccattgagaaggccagggtgttgcgggagctgaggctgccattgtggccatagaaaacagccccaaccagcaggtcctgctgagagaaggctgtggctggctgagtggcttggagcaactgtccccagtgagggctgtctgtgacgtggtagtgggcctcatccctactgcagatgttgaggttggtgcccaggtggagctcggccatgttgatggtaccctggcctccttgaggaaccatgaggccggagccattggccacacagaggtaaggctccaaggcctgcacctccagcaccgtgatggcctggtgctgcccatcggacacctgcagcgggatccagccgtggtcagcctgagtgtgtgaacaggactcgcctcttcctgaggcccctcctggatgaagcggcagatgggctgcatgggctcatccgtggccatgatactgccagagaggaggtcctggtgggtcagcaccagctgggcctcagcaaagcccgaatcagcattgctgaaggccatgttgtctgtagtcagcagccgccacctaccccaggccacgtggaagacgcagctgatggtctgcataggggcgtggtcattcacaggctggatggccactcagaagacaccccatacctcctcccaggccacgtcaccactgctctggtcctgatggcagcaggaaatgggatatcatcttctgtgatctcggagtcatcatgctgctagaccagctggccatgcatcaggtctccattggtgaaggatgtcaccatagtgatcttgtcctgtgtcccacgccaagtcaacctcccatggcggggctgctccatgacctcatagaggtacctggcactgttgagactcttgatgaagagctggtcagcagagaggacacacccaccaccctcgggcaccacgaggacaggcatgtctgggtcaccgccaatatggatggagaaggtacagagtggggagaaatatggtggagctgtgacatggaaacagaaggtgtcctccactgccactgaggcacgtgccatggccccataggtcacctctgcagcctgtacgtcatcctgggtgaagccctgaccgtctgacagcatcgtgccctgtagttgaaagttgcctttcctgggagcctgaaccacctcacagtggaaggttggggggcttgggcctgcctcctccagggtggcctccaggtgggctgtggtgagggcctcctgctgggtgttctgagtgtgcagtggctccagctgcagcatccacacagtggctctctggatggtcactaggaaggacagattgctcaggatttcccagctcacctgcacctgcagatccaggttctccacggtgtcctcggtgtagtgctgtgggtcagtgctcaggtacctcacgtggccctgctccacatcctgctggtggaacgcctgtgtgacccaccactcagcatcctccaccccaccagccccctgcttctgcagctccctgaacggcaggcctccggtgacacggaacagcacggtcacatcctgccccacggcgctggtctccaccaacaggttggtaggcaagatgggcatggcagagccctgggccagatgcagccctgtgctgcggtggatttgtatggccagctggacagccaccaccttcagcatggccggggggctggcctgcagtccattgctgacccggaatgtcaagtcctgtgtagggccaccacagtggacatagactaggctgccggcctccaactcccagcaggagaactcagtcaccggctccccaggctggtctcggtgctccacagggaggccagagggggtgccaaggagctggaaggcgaggccctcacaggcagagtccaggtcataggcctggagaacctcaggccccagaggcttctgtgtgtgttccaggatcaccataaggctgccatgtgggaagatgatgtggggtgggtcattgacagggttgacctggatgggcaggaggtctgtttggcccctccgcaggcatgagggcatgggcaaccaagccatcactgacacctccagcaccagctggtcagaggtgtcctcagggccatcgtggatgaagcgggccttgcagttcaccacgtccaggagggtgaacatttttcatgcctgggcacccaggacatccagctcgagctcgctgtagtgtgcccctcaggtcacgctgaacagcacctgggatttacgcagttcagcctccatcagtgccagcatgggctgcacatgccaccactcaagccaggctgtgccaccctcggtcaccaccactgcgctgatagcagctggatgaaattggcaaagacaggaggtagccctggctcaggcacgcatggctcagctagctccacggacagccaagccttgggagccagggtggagaaagcttcataatggccataggcattgtctacctcctccagtctgcagccagccaccatgttgtgcgtcagcaaggcttcccacagcccctgcctctagccattgacactgaggtcttccatgcagccagcccagcagggaggcattggcagcccctggtgtcaggcctgagcggtgttcctggaggtgatgagaggcctctgcaaccagctccccaagaaggagactgtcacgtggctccaggtagctgaggactcctcagttcgtgtggggtactggtccatggagatttctagctggtgaatgttgatgtggatgctgaccttgtggggctgtgcgtcagtcacaggcacactgttgaggagcaatacagtaccctggcccttctcaaccatggaccacaggtggccctcaaatatgtccacatggatgaagtccccatgccagcctgctgcctggaaggccaagggtgcctgccagctctgtgtggtgagtgtaaactccagggttccttcaccctgagtgccccaggcaggcaaggcagccagagagtgggacccagagaagcccagggccacatcatcattggcagaaaactcttcagcacagccctcatgcttattgggggtcagaggctggaggagtctgcggccattgagagcggctgcatggaggcaacccctcaggggatggctggttcccctcaggtacggcaggccaagtctcccagtgctcccaacaaagagcccataggggacttctaggggggctcccaggactacagaggaggcattcagaaacccattgactgacaatgtgggccagtcctctgagacagtcagaactgtggtgtgggggacggagccactcagtagaatttctgctggggtctgcagcctcagctcctcctggcccaggacaagcctgacctgaggagagacggggaatgggagatggggggcagcactttgaatccatcatttcccttataaaagcacagtgggttccccacagggggccccagagcagaaaacctaggacaagggcctctggtgccactcctcttgccttcctgccatctctttattcatcctccaaacactcaccaaaggaaactctgggccaggcctggatgggctctggggaccctggtgtgaatcagatgtggtccttgcccacaaggaactgacatatagcaagatgctcttctagaaacccaacctgtatttttaaattctcctcctctttccttgagtgaaaagcaccagaaatattgtcttggaatctagatttcacccctggaataatgggtaactgagaatccgttgatcagtccccctaagtttggcaaagtttctcgaggtcactgaaggaagccaggctaactgttcagggacagggagcccaggcagatgctctgtgttctgggaaaaaaaaaaaaaaaaaagctgcctgacctgtggtggaggaatatctcaaggagagatgaaggacatagttctgtcaccatgacattgacacaagaaatggctctggtatggtgctcccagatgctagaataggtgatggcagagtatgggaactgcagaggcagaacactaagaaccatgatcttggagtcctggtatggtgcatctctgtagggatgtggcatcactacctgcagagctcaacagccatcagcaccagactgcaccacataggtgttcaacagtgacaccttgtggcaatgagcagcaatgacagcagcagactgaccaagccctagtcctcttcccactggggtgtggaaagagatggctgccccaaatttgttaatttgttttttttttccttctaaaatagagatggggtctcattgtgtggctcaggccagtcttgaactcctaggctcaagtgatctttccaccttggtctcccaaagtggtgggattataggcataagccactgcacccagcctgccccaaatttggactaagaccctgggttcttaaactcttcctggtatggggtaagactcaagtaggagccacaagactccttgataataaagcttgtggtgtcttgaaggatgaaatggaaaaatgaagctgaggcagtactggtgctgttactctcatggacagacagtggtgctgcagataaattggtgcagtgccaccaggatgcgcaggggtcatgggggcccaggagggggtctcgccgaggaggaggggatgcccacactgaaacttcaaggagagactagagttcggcaggtacagggaatgggtgggtcacacacctggcaggaggagtgtgatgaccaaaggcctggcagcaagtgaccataagatggccaggaactgaaagcagttcagtgcagtcagagcacaaagggccagtgagggcttgtggtgggaaacatggttggaaggagccggtgggcagagccagttcatgaaggatttaccatttctgagctgctgctgcccatcccacagtggagaacttgagaccccaagaaaagtgacttacacaaggtcaacagccagctggggttcactcaaagctagacaaggaatctcgccccaatcccagggggacgtcactcacctgcaggtgtccagagtagagctgcagcaggaggtggtcagctgggcctgctgccaggagaaggagggcttcgggttgggacatggagaactgcagctgcaggtctatgtcagtcagagccatggccacagtcacctccgggtggttctaaccaaagaaggaagctgtgtgagagagggagctgtggtcaaggctcagattcttgcctggaggaggcgaggtgctgcagggagggatgggtgggttgcagaaaggggtccgtgctggtgcaccctcatggttctgccatacggtgctgcctctgagcactgcccagatcccagcatttccttggtcctggcaccagaaggcacagcctcaccttgtgtccagcccagaccttgacttggcaggaggtcagacccagaaattcccagcaactcaggtctcctccttggaggttcctggagccagaggcctctgccagctctgactcacctcccctgggccccagaggagtctccctcccaggtctggctccccgacctggcccaaagggaaacatcactggcctgatcacctggcttggtggtcacagccctgaggaatggagtttctggagaatcaccaccaggccagatcgatccctgctcagattccttctcctaagtgcccttgtgcttgggctcctgtgcagcacctgccgtgccatgccccacctccatgggttggctggggccacggctgggatctgggggtgatgtcagtgcagcccacctatccctgcttctccctcaggccattcttccagctgccattgagggtgggggcaggagcttattggcctgagtttgccaaggagtaaaggctctcaggccagatggggaccatatgcagtgtcaaaccaaagtgggcccacacttcctccactaccctgctgttgcttcctgctagagagctattcacagtccccgctgagcagtcagatccggccccattgtttccaccgtggccaaggaaccagggatgagaacagctcagctcccaacctctccaggccaccactcagtctgaggctgaagacagggcctagaaggggctgagggtctgctgagcaggccaaagagggcctccccaggcagaaggccatgtctgggcttgcctgggattagtggttcttatgcagggcctgttctgtcccacactgggactcctcctcttttgagttgctgcttcctccaggcagtttccccaaattagcctccctgacttccaacccgatgccataatttctggtctatgccttttgcggtgataagagccaaatataactttaactttgcctgcagatgtccagggctggggggcagacaaacacaggttaaaaactgtgattcatccctgttgggtttccctcaaaccccaagaacaagcacaggctgatggccttgatggggtgattcagcaccgacctcacatgcactggtccctagccagcctgagccagctgccatctgctcgaggaagtagcttcagccattggaggagttggaggtttgtataccctcagggcagccagtcccacctggagggatatccaggaaagatcccgtaagagcccctcgggttgagttaaatcccctctagttatcccctcctcctgccagcactgctggcaacaccagcaccttggctgggaagctaagggaatcaagcaagccccgcagaccatctgcacgggggtggcccagcagtctcagcaggcacagcacagcttggtgccagcaagagacagaccagggaactgcaggtggcggccagctactggggtgccttatctgcaaagacattgattcctaagagcaaaacacagcacactaaagtgagggaggccatagcacaaggggtgggggcacatggccctgcaggatggagccaccacagtcaccggctggaacggctcacagcagctgccaggagccaactgttgaattttcaggaattttgagaggcaggtgatactgcccacagtgggaatatttataccaggaaaagaggcaaatactgaaaatcagggttccctctccccaacaaagccctttgcgaaacatttacctacccagcacccacggggaagggggcacatctccctgtgcctacccacctgtgttaatcagggttccctagagggacagaactaataggagatatagacagatatagatatagatatagatatagatatagatatagatatagataatagatatagatatagatatagataatagatatagatatagatagatatataaaggggagtttatgaagtattaacttacacaatcacaaggtcccacaataggctgtctgcaagtttgaggagcaaggagagccaatccgagtctcaaaactgaagaacctggagtccgatgttagagggcaggaagtgtccagcatgggagaaagatgtaggctgggaagctaggccaatcttaccttttcatgtttttctgcctgctttatattcgctagcagctgattagaaagatggtacccaccagtattaaaggtgggtctgccttccccagcccactgactcaaatgtttatctccttttacaatgccctcacagacacttccagtaggtcaatactttgcagccttcaacccaatcaagttgacactcagtattaactgtcacaccacccttgcactaaaggtatacatacacccactagggcatggtcaaggtcagagatctgggccagacaggaactgaagtagatggttggccctaaccactgaaccacctgcctgcggcctcctcccatcagaagagagtagagcctgtttggccagagtggaatggtggcaggaagcagaggtactttccgggagcgctggggtctgaatgggtccattgaggctgggccctgctgcttcctgtagggctgagtgggagaggctcacagaggctgccttgtgcagctggagcgcatagccagggaggcccccactccaacagaggcctctgaggccttgctggccggggctttggaaactctgacagcgctgcttccctcacctcctgatctcctttttctgcccctcttacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagcccttagagacctttttgtactatccatgacaagctcttgatgttatctctgcacttttgacaaattcttagcagttaacttacaaggcagttaagatttttgttcaagcacaatatagctagaataggctcatacattcaataaaacaaatatttaccaagcatttattgagtggaagataaaaagcacaaagcataattataaaatattttcccctgccaccataaaaaaattaaacaggcttacagaatacagtgtaagaaaacatgaccaaagcaaaaatagtaaggactaaagaagggaggaaggggaaatatcaacatggactgaatatgacccagaagagccttgatggatggtcagacatgtaaaggcaaattggttagggttaaggggtggaggtcagggcacgttctatagggaaacggcagctgatacagaagcctgaaaggaaaagcgggcagggcacctggacaggactcttcaggaacgagcacgcacgtgcgtgaaaaacaacttagtgaggtaccgttcacccaaacattagagaaaccgcgtaaaaatgcttcttggtaagcatgaagaaggcagggctcggcctgtagaagaactcaataaacatttgaactgtctaaagagtaaaagttaatgaataggccaaactcactcctttctttgttttaagagctacaactttagagaataacaaatcacaaacccagtagacaggtcctggcatttgaaatccaaccccatttttcccttaatctttcccctctgagcaaatggtatcgacatgaacaagccatgttgatttgatcaagacactcatccatggttaaaagagtctttactttcaagagatacaaacagaaatatttacatgggctaatttactgggcaacaagagagaaactctgtctcaaaaaaaaaaaaggaaataaaagtatacaaagtgaaaacaaagaaattaaactgcccttatttgccagtgacattactgtctatgcacaaaattccaaaaatctacaaaaaagcttctagtactaaaaatgagtttagcaaggttgtagaatccaaggtcagcatataacataaaatcaccttcctatatactagcaatcaccaactggaaattgagaagtatcattcacaacagtaccacaaacatgaaataaatgtgtaagattacaaaatacaagcaagatccaactgctaaaaactacaaaacactgacgaaaaatctaagaaggtctaaataaatagatataccatgttcatggctcattattaaaatgtcagttgcctcctaactgatttccagtttcaatgcaatgtcaatcaaaaaccccagcaggctctcacgcctgtaagccctacactttgggagaccatggtgggaggattgcttcatcccgggagtttgagaccaggctgggcaacatagagagaccctgtctctacaaaaataaaaaaattagccaggcatggcggtgcatgcatgtgatcccagctacttgggaggctgaggtgggataatcgcttggttcaaggctgcagtgagcagtgatcctgccactgcgtttcagcctgggcaactgagtgggacacttttttttttttttttttttttgagacaaggtctcgctctgtcgaccaggctggagtgaagtggtgcaatctcggctcactgcaacctccatctcctgggttcaagtgattctcctgcctcagcctcccaagtagctgggattacaggtgcccgccaccatgcccagctaatttttctgtttttagtagaaacggggtttcaccatgttggccaggctggtcttgaactcctgaactcaagtgatccacccgcctcggcctcccaaagtgctgggattacaggcatgagccaccgcaccaggccatgaaacactttcttccacccacggctttctcttctctccccatttacagcagtaagacagcctaacctgggaaagagagagagagggaagctacttccaaatggatgcctgtccccatcagtaataaccaagtctattcaagtgctagatgttaactttaaaagaaggaaacatcaaaagtccaagtttcagccgggtgcagtggctcatgcctgtaatcccagcactttaggaggctgaggcgggtggatcacgaggtcaggagttcaagaccagcctggtcaatatggtgaaaccccgtctctactaaaaataaaaaattagtcaggcatggtggcgtgtgcctgtagtcccagctactcgggagaggcagaagattcgcttcaaccggggaagcagaggttgcagtgagccaagatcgtgctactgcactccagcctgggtgacagagcgagactccgtctcaaaaaaaaaaaaaagtccaagtgtcttcgcctagctttgtcaggaatgtttttaccctcagtctgtaagtgtgaccaaatatattttttaaaggtttaccctcaatctgttaagttcaaaggtttactataatctcttcataagaaaactattggaaagatggaataaaatacacagaaatgtccttaacaggtaaatatttatttttctttcttattattatactttaagttctggggtatatgtgcagaacgtgcaggtttgttgcataggtacacacgtgccatggtggtttgctgcacccatcaactcgtcatctacactaggtatttctcctaatgctatccctcccctagccccccaacccccaacaggccccagtgtgtgatgttcccccctccctgtgtccgtgtgttctcactgttcaactcccactacaggtaaatatttctagaatgtatctactccatcagctagtgtaagtattctaaactgtgctagtatagctgctttaaatcactgctttcttctgcaaatggtggcacctttaaagtgttatcttgaaggggaagtgagtgatttgctcatgtctctactgaactaacactgttaacacccagtccagttctaccttaaacaagtcggagaaatacagacataatccatacttgttatttgtcaagactaaggtaaaataaggaaagttggaactcactcatatcctcttatgactgatgtactgaaaacaatccatctctcaccatttcctaaatagcatagtcacaaagagctctaccctaccaagtactctgcaagtcccactctcaaaggaagactcacaggtgactgagaagataaatttgctattgtttccattatccttcagttcatctgacacctttgaagaaatgcatttggataagactcacaagtctcagggccccttctttatgaaagaaatagctaagcctccatactcagaagcatcagacttttcagaatgcttaagtcatgtaaaaacgtatcaaaattattatcattacagctaccaggaaatagctacctactccatgttagatactgcagttaagtatctcacacagtttcactgattcctaacaacactgcaaagcatgttactaacccttaaggagtaggaagctgaagctctgagaggctatgcaactactcaatggaaatgtggggatgtgaactctacctagctccaaagggcgtacttttttctaaaatttctaatttttttccaatttcacaatggaggcagagttttcactacaattttaataatttcaccagctgggtggggtggctcacgcctgtaattccagtactgtgggaggctgaggtgggaagacggcttgggtcccggggagacaactgggcaacagtgaagattctgactctaaaaaaaataagaatttcaccaaaagggggaacagatttctaaatcggaatctcttgttaaaatccttagagcactagttaagccccacttcttttcaaaaaataaccgacagattaaaaaaaaggttagaaatccttttaaagtaaatttcatcagagatctgcaagtgaattgtcattttggacaagtccccagagttggtggccctctcctgtgtacaccagctaccactaggcagtaaaagtaatttacccaattcaaacacataccgtgcctgcactatgttaagaccactggcaaagagggtacaaagttaaataaggtctatcacagccctcaaggagttaaaggactagaggaggagtccatttatagtatagtatgtgtgcagttaccatttagtcaaggcaaacgaactgtgagaaatcctacaacaatagtacctacagtataacatgccatcaccgcccacagaaggaaagcaactggtgccctcgtcacgttatgttgttagtacttgcttacatgatgtccctccctgacaatcccttccaacctctgtcagcctccttccccacaatcacacacacacacaaaaccacactgccaggaagggaagccattgagtgagtattgtgaatcctacaagtggctctgtagtttaaaagggcaatgcctgtgcctgaagaaaatttgtctttagcttcatcaggtgaagaaaattggttttataacacaaggcccaccaaaccagaaaagcccaggaacgcttctccacaggactcacttagcacgagaaatcactcagagcaaaatgacgcacacagtatttgtcaaatttttctttttcatttagcagaaggtaaggtaaaggactacaactgaagttaataaatgacactctagccattttgatcatttgtcactataaatgatagacatttaagctagttccatctggggaagtgaaacagaatcatgttcatataataagccagacgaaccaaattcagtggaatacgtgcacccaaaactggaccagacttgtacttaatgcagcctgcaaatccccaagagtccacgacagaatacaagaacagtaacactggtttatctcaactcatcttagctccctcacaaacttgccaataatgacctttcaagaactgcaccgttggtcctcatctgggcaatcccgtggcttagaaaaactgaataaagtgcttcttcgaaaaataaaacaatgcggggaggggggagtagtaacaaaaaaaaaggcacactggtttttactgtactgaagcaataaattctccaactaacttcattaatgagtatcagcaaagaatgaacaccaaaataccgctcaatccaactttcatcgtgaattcttgaattcacagtaggatcattaaatgtgacggtatcactctgctataaaaactatttccaaaacaaaacaaacctatctaccccctttcttgatttaaaaaaaaaaaaaagaagaaagaaggaaaatttgagggtttttgcttttttcaacttcacataccggtttgcctttgcaaaaaaaaaaaaaaaaaatgtttagtctcaaagtatagctgcaaggtggaccggctgcacgggtcccagagggccgctcgcctccgacggtcgcagtttcagccgggccgcgcccgcgagaaacagcggagaggccccagcaggcgggcgccgccggacaggtttaccgtccgcgtcggccccggggaaccgctccctcgcgcccgcagcacttgttcgcggcgcggactccacaccgcggccgcccgccccaggggaggagtgagtccgccccagcggcgccaacccggggacccggggcaagggttcggggccatccgccgccgggcgcgccccccatccggaaagcggcgacggcccccaagttgggctgcggagtgggaggcgcgccgagccccaagcagacaatgcgggagaagggtgatgcgcagggaggaggggtccgcaaagctgaggtccccgcgccgcccggctacccatccgtgccgcccgcccctgaagccccgcgcagcccccgaccctcctctggggcccgccccaccgagcggccgcaggggacgggccgcgctccgcaccccgacccctcctcaaatcacaaaacttcccccaactccgccaactaagttgcgctctcaccgtgcggctcccggggctcccccgcgggccgagccgagacagctcctcaccttcgccgcggagaaagacaataggctgcctctcccccggcggcggcagcagcggctgcggctaaagcggcggcaaccgaggcgagcaatgggcacggcggtctcggccgagccgaggggcttcaccgctgctgttccggctccgcgacagctctgcacgtagccccagccaccccgcgcaccggctacaagccgcccgggggtggccggggcacgcaagagggcagtaacgtctgcgagtcctcccgtgagtacacgcggagcaagggctgcgagctgggattgcacggcagagctgcccatcccgctccacgagaccaatagtaaggcacctgggcggggcgctcaggttgctaagggaggctgaggttgaccgccggggctgctctgtggcaaagtgatcacagcagggtggctggcagagactgctctgggaaatgcccactcacggtctcctctccgccctgtttctagaaactgccctttctctgtgtgctcgtggttacctgagctgtagcatttaaccacacatcgtgaaatgatttactcctctatttcccccacttcaactcaggaagtggggtttagtcttgtgtgtccacagcctaggacagtctaaggtattaggtattaaatataggtattaaacaagtgttggatggatgcacggcgctatggcggaatcacaattgtgacagtgcattccgtgaacttttggctactcgatcaccacagtcgttccgtgttcaagctgcaaaggacctcagaaatcatcggattgctttgagaaacaaaatgtggtccgtgtaccaacggcggccgaggagaatatattagctggtacacggagaaacttcttttttcaaatagttaagtgttttagtgctcattaggagggaaatgcctatcacgtcaaatcattgtttcattaatgttacttcttaggtcaaataaaaagtggcaaaaaacaagtgtatttcaagaaaagtgttaagtgaaacttgagacactttatatgcagttcaagaatgtaaaatactagttgacagtgattgaagtaagaacagttggttaggtaggaggagaagattattggctgggaaggaggaggagggaaccctctgtggtgctgattctgtattttgacctgggtgatggataacaaaagtatgtacatcaataaaaaatacatccagtgcactttagattagtgcactttacacattttatacatgtatttttaatgtcaattttttaaaaatctggtatggtatatacccccacaacccccccccccaaaaaaatgcaaagatgcaaatgactgccatttgggaaacactgatccaggcaggctcactagcagtgaccaaacacctgagaaagggtattgtgaatacctgatgtatgtgccaggaacttccatggttgaatagctccaaatctcagaaatgctcctaacctagtgttgagctctggtgcatagatatattttcttttctttctttcttttttttttttttttttgaggcagagtttcactcttgttgcccaggctggagtgcaatggcacgatatcagctcactgcaacctccgcctcccaggttcaagcgattctcctgcctcagctgcccgagtagctggaattacaggcacatgccaccaattccagctaattttttgtatttttagtagagacagggtttcaccatgttggccaggctggtctcaaactcctgacttcaggtgatccacccacctcggcctcccaaagtgctgggattacaggcttacaggtgtgagcctcagcatccaacccagaatagcttaaaaaaaaaaaaaagccaggcatgcccagttcttcatgtgaaattatttctgtatcacctcatcatgctgctcaccctcttccactgttctctaatttgtccttgttgatatttaaaagctggcacaaggccgggcgcagtggctcacacctgtaatcccagcactttgggaggctgaggagggtagatcactagagcccaggagttcgagaccagcctgggctacaggtgaaacccccatctgtactaaaagatacaaaaattagccaaacgtggtagcccaaatcccagctacttgggagaccgatgtagaaggatcgcttgagcccaggaggagaggttgcatgagccaaatcagcagggcagctgcagagtggggtgcaaggtcctcaacccagaggttccctaggccccacttgccccagctcatgagagcctggttctgagctctgccaggaccggggctcagcactgcccatgaaaacaggcgtggcagggaagaaaatcataaccaaatatttgtagtcattccagaacctcccttctggaaagggaggttcccaggtttgtgggctctttgcctcctggacattattgtgtagtgaagggagaaaggttgagatgcagagttggagaaactaagagaggccgaactggtccatttgaggaaagatgactgatcccagaaggggaggaggggacaccctggggaagcagggggcttcccagatggtccaagaaggggagggcgggatatagaaagtcagagcatggttttgagttttggagacaacaagagaaaagagggagggatttggacaactatggagaggactgggctgtggagagaaatgtttagagatttggaagatggtgtgtcatgcgatgtattgtgaaaaccccttcttcatatccctaaaagaccaccgctgatggtgattcatggtacaattgatgattgtatcatgatataattcagtgcttttgcagagggattggtgcctttttaaaataataatgatgctttggcttggctccatctgaattagtagagacagacatcttgagcaggttttatcagagttccattagctaaatattgggtttcctattttgtggcttgctttaaaccactttgtaggcccttccgcactgaaagccactacagaaatcacctctttggtctgcagctccacgtccccaagctctgggctttcctgaatgagtggcctcattcagaagataatacagcatccctcatccgaaaatccaaaatctgaaatgcttcaaaatccaaaactgtttgagtgccgacatgatgttcgaaggccagattcaaaggaaatgctcattggagcattttggatttcagattttcgaattccaaaatctgaaaaaaatccaaaatctgaaatacttctgtaatttaacctgtaatagacatttggtcctgaccttccagctgaggcagcaagcagtcaacagaggctcaccatgcatccctcctgctcctcaccctcccacgggcttgtgcctcaccccccagcctcccttgcacctgctggggaggggacaggatgctcctgctctgccttcttggatctcgggctactgtgataattgcaggattccagccagggaaaatgctacaggtagaagtacttggtactctccatagagaagtttccagcaatggcacatctgccccaggaagtgtgctgccacacccagctaattttaaaaactttctgtagaggtgtgaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatcccacatatggcgtgttgtgtgtctatggagtgtcgtgtgtgtgtatggtgtgtagcgtgtggcgggactatatggagtatgtgtatggtgtgttgtgtgtgttgtgtgtgtatggtgtgtggcgtgtgtgtgactgcccctactcaggtccctatgtgaagttatgagcagggcacggcctgggcctggacctccctcctgcgtgtggatctgatgggagcagcggtggggaggactgcagctggtcgggctgcctagggctccccttcctctgcctcgtgtccttcccgctcgcccatcccttcgaccactcacagtttcactaagccctgtctgcggagcccagggcctgctcaccctggagtggcgcaggggaaacaggaggatctgggggcacaggagtgggcgaggggctgagtctgggggtgaggggagcagggcccggcgaccaggcggtgggcacggagtctggggtgagctcgagctgcgaaggtggagaggctgggccaggggacccgcgtgggcagcagcatggaccggggcgtcagagtgcaagatgtgagacctatgtgcgcgcggggcggcggcagccggtcaaggggcagcaggaaatcagacctcaaaggtggccggggacagattccaaggacccttgcttgaaggctggtcactgtttcctttgggcctccaggagtgttaggtcgaggactggagaggggaggcagttctctccgcgcgccccctgtgctccccagacgccctttgcactgaaagccaagggccggaggctggagcgcagcggcccgggcagaagccctgcccagacggcgccggacctgggcccggactctgcgagcagcccagccctcacttggacaaaggtggaaacggaagccttctgggagggatgcgtattcccgcgaatccactacacttctctcgggatgcttttccttcttcaggccaggctagcaacgcaaacctcgactccagagaggccggtgtgcgtccaggggccaccccttcacaggccgcgcctgcacccagcgtctgttctcactgccggcctcgcgggcagccagtgggtccccgggtgagatggtgcgggcagcgctcccggaacgatcccgggcccctccttccccccgggctcttgcctgcgcctcttccacacaatttgcgatttccgtggcgtcagatggctgttctttgtcacctgcttgtaagagctggtcccatgatgtcaagcctcttctcctggtcaaatccagtttcccctcagtttccttcatcggaattccttggccttcgtcattcttggctgcatgaacctttgatttcctgtactctctggtcctggctctaggaatgatgttatatgtagcgcctggcggtgtgctgtgcgctcaccggaggaggtgtccctattttgcaggtgatggaactcagttctgggacctttctgaagtcccgcggatccataggcacagtccggccgcagaatatctggttcctccaatgtttttgtcttccagtctccgtcttgagtatcttttctgtaaattcatttgtttccgtgggtccgacttctgtctattttattttctgacatggtttaaaacacacccaagccctgatttcattctcggtggctccttgggcgccccctcttaggcatcctgctggggtctgaaactgagcccagagctcttctcaaacaggagctgctgcctggttctctgctaaccagctggttttatgtatggatggctccttttcgttctttctctacccgggggcacaagcccttcgtttttagcccctggctactgctgcaggtcgcccaccacgtcctgaccccacctgccgcccccttcacccttcagtccccccacctcatagatggctgccactgccacagctggttccttgttaccagattctctctcctattaatattattccttctgaatatggatgcc

SEQ ID NO: 737 - DNA, 318577 bp, Homo sapiens
  misc_feature (87656)..(137655): n is a, c, g, or t
cctgtgctcttctcgctatgctttttcggagatgtattctcacacactcttagccctttggtcactgggctgccctttggtcacagggctgcagcactacaatcctagcatgcatgggactgagggagcatgcgctaatcagtggaggaaggggcgaggctctgcacgcctctctgggcttggtggaagatgcagtctcataaacactcacagcccttttgtcacagggctgcagcgctacaatcctagcatgcaccgggctcagggaaagttggcgtcactggagaaagaggcagggttgtgtgcacctcctgggcttggtaggagatgtagtctcataaacactcccagacctttcatcaccgggctgcaggactacaatcccagcatgcacccagctcagggacagtgcgcattactggaggaaaaggctaggctgtggacccctccttctgcttcctgggagaggtagtttcatggagactcccagaactttcatcacagggatgcaggactaccatcccagtatgcactggggtcagggacagtccgcgtcagtggaaaaagaggcggggctgtgtgcgtcttcctaggcttgctgggagatatatgctcataaacactcccagccctttggtcgcagagcttcaggactacaatcttagcatgcacctgtctcagggacaatgcgtatcactgggggaagaggcggggctgtgtgctcctccctaggattgctgggagttgtattctcataaacactcccagccctttggtcaaatggctacaggactacaatcccagcatgcgccagtctccggggtaaggcatagccctggaagaaggggcaaagttgtacatgccccacctaatatgctgggagctgtagtccgttaactgctctcagcctatttgtcggtgggcttcagaaccataatctcagcatataccgggatccggggtgcatagacctggagggagggacagagcggtgtggacttcccagtgtccaaagcattgctgagttcttatgctatgccgactctttgccacagagagtgagtacagaggtggacctggaggacaggtctgggctgagcattgaggagggtattaccctatgtaggcaccttacctttgcccaaatcaggcgggttatcctcacccgattggccctatgcttctcaggttcctctttcagctgcacccagggttccttccagagcattgcaccttctgcagctcagggcactgccttttttcctaaactactgtggaaactgtcctgatgtctgagacactgtccattgtgcagcagccctcttttttctctagccagagcgcgtgctcaatggcttttgagagaaatcttccacatggcctgcttgtgaacagcttcagagctctgcaggggctgacaagggctgagccttcctggaaacgtcactctcaatggcgcctttttcacgaatgtgaaagtcgaggcatcaggaagttagtttaatgggttgcagaaaatctaagagcaagggagaaaacccgctttccaaggcgtgagttttgtgagccattttcatcaacccatttaagtggacaagctccaaaatgtaacctgaagctgctgactatttaggcattttacaattaaaatcatcggtctcatcccaagtcgtgcctcacttgccagtgtctcagagacacaaatgggacctgatccctcaggaacagatagtgttccaggttcgtgggagcgacttttaagttgtggagcacttggggtcgtttgaaacccactatcttcagtagggacttttacgtctagagagcatgtgcattttgattttatctgtcttcaagctgaacctttgctcattttaacaagtaaaaacacattcctgggtgaaatgtcattgcatgctaatgagacatgaaacatatgcaaaaatatgtacagctactgcacatgtgcacccagaagaccagtcaaagcatgccttctataacacttctttccaccttcttatgaataatcatgtaaaactcccagaaggagggtttctccagcaacaattaatgctgtctcactcttatgagcaggctgccctggaatctctttctcagactgtaccgtctattctgcacttgattttcaacgtattcttttcttttttgtgtgcaataaattactctatgctgtacttcttttgctgcatgtttcctgtttaaattcttttaagctaagaagataagaaccaaggtattacatcagccatcaacatttcttttgccatggcccggagagaggtttgtctgcttcattaatttcagtttcccttttcttgcagtgaatactatggcacttccagactacctggttaactatcgctggttgttccagcgctgtttcactaaagttctgggggaaacgtgtttaaatcacctatattctctagagagagaatatatgtctgctctccttttggctgctgcatctgtactatccataaatgacactcaccgcatgggttgctctcaacatttcatattcgggctagtttgctgcttagtttcacatctttctggccacacttcagactcagcttatcgtttgctgtcccttcggcaatactcgatcgccacctagtggctattgtactttattttctgatcgggttttctgtttacagttttgtcttgttttgttttgagtggaatattaagagaaccctgtcccttcaggctttatgcatttcccacctccttgaaattgttcttcaacaggttttctttgctgaacaaacgactcaaagtcatgtagatgcccggtcgtggggtttgaatctgagcattgcaggtgtcataattcggcatcataaattgcaaaccagtaaattagggaaaggcttgtcagccagacatctgccccccagccagcagtgggggtcatctcggcacggctggagatgtgcagcgcttgtgagagataggacggtgtatggcacatgcctatgacctcctagagcttcagttaatggggtctcgaggggctgtgctggacaccttggtggttccacttgtcccattgtgatgcccatggcctcctggactttagtacatgttctgacgttgcaagattccgtcggcaccatgggagccgcttcctctactgtcattgaaacacccctgggatgtatatttaaaaattgaaacagcttttggctagatgaaccaaaaaaaaaaaaaagaaaagaaaaaacttatcttcttttgtaatactatttagcttgcatacagattagctcacaaaacatggctggggaatgagactgtgaactttaacaccctcctacagctagatcttttctgtagaaatcagggaaaatggtctgaaatatcctatgtgcaaacctttatggcctgacaacaaaacccagctctatgcagcacctgtgggctaaagcctagtaagccacaaagcccctcagaagcattagaagatcatctcttattaaggggaagggaccccagacccaacagcccaacaccagctccagatagggactctcaagggcctacacctcctgtagaatccgcagcatccccacactatcagagtcttctgtagaatctaagcttgtttcacctcctccttatgctcctctctatcagcctttgccaggtacaatagtgagcagcccagctgtagttactcgcggtggaacttcacaccatgcagggccagagaatttgatccgcttacagaaagtcccaaatggagagaggaccatcagagtgcttgttctcttctcaataaatgatctaatccaatgcacgcaacagctctgatggctcccaaagaacttcagcgcatttactgaagccttccaggctctaactttgaccaccattcaacttcaccatccataaatggacccaatgactgctgaccacgtagctgcagaaaacttttgcttattggcaaaaaatagaaaagacttaaaacttttgctgctttcaccatttcaatgcagaattcctttgcagcacaaatgtcaccataaggtggagccttgggaatccagtataaactatctcagaaaatctcagtgtgtccccaacaggcagcagagggcctcaatagacttcaacaacatctggactccatggccactgtagtccgacaaaaccaaggagcctgggatcttctcccagccgggtaaagaggaacatgtttatatctaaaagaagaatgctgtttttgagatcaatcagtctggtttagtcgaagaaaatattaataatatcatcacccaggcagacaaaattgaatctctaggaacttccatgggaacatgaaagctatgtccgttgtctgccttgctctctttaatagtacccgtcattattatattttcaacttttacttttgttccaattttgtttaaaatgttaactgatttcttgctctcttgcttacggcaactccatgtttgcatgatggttttgcaaggctttcaacctttggttgccagcatcttcccactggttccacgaacgacatggtttacaccctgttagatcacacaggaagaaactttaaggcccaggctaggcagaagtaacacccgctcagcaggaaacagctccagaaataatggcctaacccctcaacctccaatatgattattgccctaaaatctcttagggggaaattgaggcagaatagatagtacagaaaatgaccatgatctcaggatacagaaaccatggtgactgtacagccaacacaataagccgtagcattcgcattgtaattgggcttattcaagcaaagttatcctcattaaggactttctgttctagaaagcatgtgcattttgatttcacctgtcctcaaacttaactttcgcttattttaatagcaaaaaatataggccctagccaggcaaggtggctcataactgtactcccagcactttgggaggctgaggaagatggatcacttcaaaccagaagcttgagactagactggccaacatagtgaaatctcgtctcaactaaaaatacaaaaattagcagggtatggtggtgcatgcctgtaatcccagatactctggaggcagaggcatgagcatggcttgaactcaggaggcggaggttgcagtgagcagagatcacaccactgcactccagcctgggtaacacggggagactctgtctcaaacaaacaaacaaacagaaatacactcctgggtggagatctaagatgctaacgagacatgcaacatatgaacaagcatgtatagtcactgcgtatgtgcacccagaatatcactcagaacatgcttataagcaactcctcttccctccaccttattaataataatgtaaaactcccgtaagggggtttctccagcgacagtccacgctgtctcactcttacgagcagcccgccctggagtatctctctcagggtgtactgtaatctgcacttaactttcaagtattttcttttccaataaattatgctgtactttttttccttgtgtctcttgtttaaattcttaaaaactaagaagacaagaacagaggtatcacatcacttgtcaacacagcaataagtcagcctccttcttgtaagcatagcccatgcagaaaaggagagtcgcatcacctaggtgctggatccagagatatgtcacaacttatcccaggcaccaagttaaggtcattgaagatagtcgtgttaaatagtttctggccccagggatatgtcacaatggctcctgtgagcagagatcaggcagcataatcacataaccggtgtgctggacacagcgataagccactctttcatctgtgggcatgacccgggcaagaaagaagagccacagcatttaggtgcttgctgcagaggtacgtaacaatctctcttatgggcaaaactcgggtaagagaggagagtcaaatctccaaggtgattcatgtagaaatttgtcacaagaaactttttaggcagggcccatgttggatcttcttatcttccagaagttaggtccagggatacgtcagaatacccaaaatacacagggctcagtcaataaaggagagtcacatcacccaggtgctttgtctagacatatgtcacatctcttttatggggaaagctcaggtaaaaaaggaaggtcacatcaaatagttgatagacccagagatatgtcactttgcctcctgcttgaagtgtctaggccaaagactcacatcacctcagtgttaggcccgtgttcatatataaacattcaaccagagttgaaatggtggcccacatctaaactcagctcataggcaagggaggactctcctatcctgacctagttaattgtaatgatgttgactctcataccgggcttaatgctacaagtacgatcatgggtccctaccattaggaaggtgtcaaagttgattacgactctcatgcatagagtatagggccattgggtagtacacagagcgtgctaactgggccgagcacacaggtgagattgtgacactcatatgcacacccagccaacagtaactattgtcatcctctcacgggaacacaggtcagtctgcagaggaattgagactctcatgcacaaatccagtctggtgttgagagggttattcgtgagcttagacccaacatacaggaggtgttgaatgtcatgcctacaactgagacagttgtgggattgttaatctaattcctggaccattctgcagctttcatggtgaaatttgccggtgcctagcacctgagtgacttgatggtctcacatggacccagcccacagatgggatattaacatattgctggatccagcacattgagggtgtaactctattctccttccttggcactgcccacagtgagcattttgacatatcgctagaccttgcacccggagatgtgagtctcctcttctgccttggcgctgccctcaggaagcattgttatatatagcttggcctcgcatccaggttatgtgactctccggcttgtgcattgcccatatgggacactgtgttatattgctgggtccactactcaggctatgtaacccaacagcctgggccctgccttacaggggcattgtgacatatctctgtgctcatcagcctggtaatgtgattctcttctcctgcctggtccctttacacagaagggattgtgacacgttgctgggcttagcaccaagttgatgatgtgaatcttctgcctggatcgagttcacagaaggcatcgtgacatacctctgggtccatcatctatttgatgcaactctcctctcttacctgagcattgcccataagacagattgtgacataaccctgggtctagcaccgggatgatgtgactcctctccttgcctggggcatgcccacagaaggaagtgtgacttataactgggaacagcacaggggtgatgtgattcttctgcctggtccctacctacaggagtcattgtcaaatgcctctgggcccatcatctagactatgtgactctctacttcttcctatggccggctcacataaggattgtgacatattactttgcccagtacctacatcatgtgacttttctctcatatctgggctccgtcttggagatgaatgtgacacatagctaggcctagcccctaggttctgtaacttctcttttttcaaaatcctacccaccagggtcattgaaacatctctctgggcacttcacttaggtaatgttatcctgttgcctggagcctcccctctggggggtatggtgacatattgctggacacagtacctatgtgatattctctcctttcttgcctgggccttgtatacattgtgtattataatatatggctgggttcaatgactaggtgttgcaactctcatgcataggtcctacccgcagggacattatgacatttctttagctctgactctcctctttttccttagccctgccaaaaagggaggtggtgacatataactggacctagcaaccagctaatatgagtctcctcttttgcctgcacccagcatattttaggtgttgtatcatatcctttgtctcaacacctgcaggatgaaaggctcctgcctgagcccagccatctgtcaaaattgtcattctcccacacgaacatggaacataaatgaggttctgaaactcacacccagaggcagtgaaaagttggaaaattggctctaataagtggatgttgtccttaagtgggtttgtgactccctgaccaagatccaaaacacttgtgaggctgtgagtccactaagataactccgttttcaaaagggattaaggctctcatggaaaaaacccattcctccattgagattgtgacttatgcacatagatgcaacatacaggaggcgttcactctcatatccagaactggcacttatgagggattgttaatctcatccatggaccttcctgcaggtgtgattctgacgtacacctctagccagctcctgagtgatttgacttttttgcctgggtgtagcccacagatgagattgtgatatatccttgaatccagcatctaattaatatgcttctaatctcctgtcttggcactgcccataaagggtatcctgacctaacactggtcctggcactttgttatatgactgtgtcctgtgctttgcccacatgagccattgtgacatattgctgggtccaacacccaggtgatgtaactcttgtctagactttacctacatggggtcattgtgacatatctgtgcactgttcacccaggtgatgggactctcttgtcctgtctggtgcctgttcacagctgggattcttacacatcgctggggacagactctaactaatgtgactgtctttttactgaggactacccacaggaggaattggaaatatctatgggcctctcacttaaatgatgtgactcttttcctgggctcatttctcagggttattgtgacatatggctgacctcagcatggaggtgatgtgagtttcttctactgctagggctctgaccaaagacagattacaatgtatcatcgggcccagcacctgggtgatttgactctcccctcttggctgggccctgcatatattgtgtattgtgacatatcactgggtccaacacctaggtaatgtgacttacctgcatggcccatttccacctgggtattatgacatatctttttgttcatcacttaggtgatgcaactctcctctttgccttgggccctgcataatttagctattgtgttgtatcactgggccaatcgcctagacaataggaatcttctgccaaggccctgactactggggaccttgtgacatagctctgcatttatcacctagaaaatgtgattcccccatttctgcctgagccctgctcacaagaaaaactgtagcatatttctgggcccagcaaacaggtgatgtgtttctcctgcctgtgccttgctcacagggaaaattgtgacatatcgctggacccagaacccaggtgaggtgactctgctgcatgtgtcatgctttcaggagggaacaagaacatatccctggcagaatacctagggatgtgactttcttgccttgtccctgtcctcaggggagaatgtgacgtatccctgacaatgacccaggtgatgagaccctcctgcttgctgactactcaaatgtgagattgtcacatatattttggcctaacatgtaggtgtgatgatgacattcataccttaaaccaaccaataggagagatactttgtctcatatccaggctttacaaaatgtgcaaaattatgggtcttctcttactatgaaggtcagagaaaataagcactcttgcatatcctgtaaagcactcagatggtacagtgtcatcacagggcccagaacacaggtgagattgtgttctctgtgtgcacacccaccaatcatcagaattgtcattcctacacaggaacagaggtgattagggaggtctaaacctcatacctgaatgccgtccacagctggaattgtaactaccacatgtgaacatccagtcacagttgggatagtgacttatttctgaacccagtttacagccaagtaaagatcctcttatctgaatccagccagctggagagatgttgactctcatacctgggcttatggccacaggtatgatcataggttcatatcagcatgaagacctcagagtggattatgtttaatgcatactctacaaagcccataggaggtacatagtgtcctaacagggcccagcaaacaggtgagattctaacactcatgcacactctggtgacaataaaagttatcctcaaaaatgagcacaaccggccgggtgcggtggatcaggcctgtaatcgcagcactttgggaggccgaggcgggtggatcacgaggtcaggagatcaagaccatcctggccaacgtggtgaaaccccgcctctctactatttatttattattattattttgagacagaatcttgctctgtcacccagactggagtgcagtggcaccatctagtcttactgtaacctccgcctcccaggttcaaacaattctcttgtctcagcttcccgagtagctgggactacaggctcatgtcaccatgcccagttaatttttatatttttggtagagacggggtttcaccatattgattagactggtgtcaaactcctgacttcaagtgatccacccacttcgacctctcaaagttctgggattacgggcatggaacactgtgcctggcaaccccatctctactaaaaatacaaaaattagctgggcatggtggcatgtacctgcaatcccagctactcaggaagctgaggcaggagagtcgcttgaacccaggaggcagaggttgcagagaaccgagatcgtcccactgcactccagcctggcaatagagtgagactccatctcaagggagaaaaaaaaaaaaaagaaagcaaagaagaaagaaagaaagaaagaaagacagaaagaaagaaagagagaaagaaagaaaaagagaaagaaagaaggaaggaaaagaaagggagaaagaaaagaaaagaaaagaaagaaagaaagaaagaaagaaagaaagaaggaaagaaagaaagaaagaaagaaagagaaagaaaaaaaagaaaattgactctcatatatggatcttgtccacaggtaggtgggtgactctcaaaccaaaattcattacatctgtgagactgtaactctcctaaggggacacggtcagccagagaagacacatttatgaatccagttcactgttgagattgagactggtgtacttaggcccaacatgcaaattctcatacctggaatccggacatgtgtggagttgttcatctcatccctgtcgctttctgcaggtgggattgtgacatacatctctgcccagctcccgagtattttagctctgtttcctgtgcccagctcacagatgggattctgatatatcactgaagccagcacctaggttatgtgactcttacctcctgccttggtgctgcccacaggggacattgggacatatcacttggccttgcacctaggtaatgtaagttttctgtcttgcattagtgctactcaccggggcgttgtgatgtattgctgggtctcacatccatgttatgtgactcttctgccggtgcccaggccacaatggccattgtgacatactgttgcatacaaaacctagatgatctacctctccttcctgagctttgcctaaggggacattgtgaaatatctatgagcccatcacccatgtggtgtgattttcttctcctgcctagtccctgcttaaagaaaggattgtgacatatcactgtgcccagcacctacctcatgttactcttcttttgttttttaggatttgtttggaaggagattgtgatacattggtgggtccaacttcgaggtgacattactctgttgactttgccctgcaagcagaaagcactgtgacacattattaggcccatctcctgcctgaagcctgcctacagcaatttgtaacatatggcattgggacatatctctgagcccatcaactatttgataaaactcttcttttttaacaaaggctttgcctataggagagattgtgactaattctgagctcagaaaataggtgatgtttctttagtttttctgcttgagccccacattgtgatgtatttctggtcccaacaactgagggaagggaatctcctgtctgggtcttgcctacagggagacttgtgaaatatttccgcgttcatcaccttaaatatgtgaccctcatcttctgcgtggccatgtttacagaagggagaatgggttattcctagacccagcacacagatcatgtgattctgcatcctggtctcttcagagggttcattttgacatatctccagactcatcaactagatgatgtgacggtcctcttctccctgaaacctatccatagtggagattgtgaaatacagcctggcacagcacctacatgatggtgctctcttctcatgcctgggtgctgcccacaggggtcattgtgacatagctgggtacagtcttcaggtgatgtaactctcctctattttggggtgcacacacacagggcattaccatatagctctgctcctcagacctaggtgatgtgactctcctgtctgttacctcctcttagggggtattgtgatatattgctgggcccagaaccgaggtgatgtggccttttctcttgcctgggccctgcatacatggtgtacagtaacatatatctgggttgaacacataggtgatgtgactcttctgcataggtcttgccaacaggggtattatgacatacctttctattcattgcctaggctatgtgactctccactcttatctgggcccttccaaaagaggggattgtgacatatcagtgaccctaccaccaaggtgatgtgactgttctcttttgcctgggtttgcatattttgggtattgtgacatatccccgggcccaacacttaggggataaaaggcttattcctctaccttatgcacagagaaacttgtgacgtttttctgcattcatcaccaaggagatgtgactctcctacctgcatcctgaccacagagaggattgtaacatattgctagatccagcacccaggtgatgtgactctgctgcctggttcctaatttaaggagtggattgctacatacccatgcctgagcattcaggtaatgtgtctctgttctctggtccctgttctcagggaagcgacatatccctggcccagcgtccaactgattttactctccttctctcttcctatatgaaggtgtaattgtgacttatatcttggaacacaacacacaggtgcaatgatgactttcatatgtcacaccagccaataggagagatcctgcttctcctaccgacacttagggaaatgaaaaaaaaaaaatccctgggtctcctcgttaagatcatccactctctcacatattacagaaagccctcgggtggtagagagtcttatcacagggcccagcacacaggtgaaatttgttactcctatgcgcaccctgcaccctcctggccattatgattttcaccctcacatataaacagaacccacttgtggggtcctgaatttcacacatgaatgcagtttatagttggaattgcgaatctcatatgtaaagatctggccacagttggaatgggaacttcgttataaacccaccgcatagaaaggtgatgattctcttatctggaccccgccaattgtaaagatgttgactcatatataggcttagggccacaggtttgatcctgggtccataccagcatgaaaatctctgaaagaattgagactgtcatgcataccatataaagccctcaggtgcaacacagaaactcctaatagggctcagcacacagtaatataatgacattgggatgcacacccagccaacattaaagattgtcattctttcacatgatcatagttcacttttgaggctctgaatcccatacccaaaggcagtttcaaaagttgaaaaactgagccttttttatgtgtcttttggctgtatacatatcttcttttgagaactgtctgttcatatcctcgcccacttgttgatgggtttgtttgcttttttcttataaacttgtttgagttctttgtagattctgggtattagccctttgtcagatgagtagattgaaaaaattttctaccattctgtaggttgcctgttcactctgatggtagtttctttttctgtgcagaagctctttagtttaattagataccatttgtcaattgtggcttttgtcgccattgcttttggtgttttagacatgaagtccttgcccatgcctatgttctgaatggtattgcctaggttttcttctagggtttttatggttttaggtctaacatttaagtctttaatccatcttgaattaatttttgtgtaacgtgtaaggaagggatccattttcagctttctacatatggctagccagttttcccagcaccatttattaaatagggaatcctttccccatttcttgttttagtcaggtttgtcaaagatcagatagttgcagatgtgtggcactatttctgagggctctgttctgctccatttggtaccagtaccacgtactctgatttggtaccagtaccatgatgtgctgctataaagacacatgcacacgtgtgttcattgtggcattattcacaatagcaaagacttggaaccaacccaaatgtccaataatcatagattggattaagaaaatgtggcacatatacaccatggaatactatgcaaccataaaaaatgatgagttcatgtcctttgtaaggacatggatgaagctggaaatcatcattctcagcaaactatcgcaagaacaaaaaaccaaacatggcatgttctcactcctaggtgggaactgaacaatgagaacacttggacacgggaaggagaacatcacacaccggggcctgttgtgggatgggggagggggaagggataacattaggagatatacctaatgtaaatgaggagataataggagcagcacagcaacatggcacatgtatacatatgtaacaaacctgcacgttatgcacatgtaccctaaaacttaaagtacaataaaaaaagttgaaaaactgactctcatatgtgagagtcacagatatgttgatgactctcatatcatgagtcggcacacctgtgaagccgtgatttcaattaggggagaaagtctgcaagagaaaatggggctgccatgcacaaatttagtccactattgagatagtgacttgtgtacttagatcaaacatacagaaggtgttcactctcatgcgtaaaaccagaatatgtgcgggattcatcccatgtctagaacttcctgcaggtgtcattgtgacaaacatacacatttgtccagcacctgagtgagtagactctcctgtttaagcccagctcacaaataaaattgggacatatcattggacctagaacgtaggtgatgtggctctattctctcgacttgtgctgcccacagggagcattgtaacatatcactgaacttaacacctaggagattgggggctcctgcctgaactctgcccacagggaggcagagcatatttctgccttgtagcatatttctgcctccatcaccagatgatgtgactctcctttctgcctgcaccttgcccacaggaaaaattctgacatatcactgggcctagtaatcagtaatcaggtgatgtgtctctcctgccatggctttacccacagggagtgtggtgacatatcactgagctcaatattcaggtgatttgactctgctgcttgtactctgatttcaggaggggattgtaacatatcccaggtgagcacacaagtgatgggactcccttcctagcctccgacctcataaaagattgttacatatccctggcccagccttaggtatgtgactctcctacctggtccctgcgactctcctgctcactccctacccacaggagagattgaaacatatatcttggccagctcacaggtgtaataatgactctcatacctcaaacctgccactaagagaaatgctgtttttcctagtgaggctttggaaaatcagtaggtcctaaatcttctctttgtatgagggtcttagaggaataccactctctcttatattatataaagcccttaaatggtacaaagagtgttaccacagggatatgttgcataacctaggggaggggtccagttatatgtcacaattagcccagggggcagggcacaggcatgagaagaatctcaccacatatgtgctggcctaagtgatacatcatcatccccactgtggacaggtcgcagtaagaacaggagagtcacatcattcttataatggtctcagatatacatcacaatgactcccctgggcagaaagaagggataagagtcacatcacctgtgggctaggcccagagatgtcactcttacttctgtgggcatgtctcaggctggagaggagaatcacattacctaagcactggaccaagaaatacgtcacagtctttctcatgggcaaagtccaggtaagagaatagagccacatcaaatagttcatgggctcagagatatgtcactatgctccctgtgggcagggttcaggtaggacccttacattaccttggtgctggttcagcaatatgtcccaatgccttctaaggacagaacaaagacaaaagagtaaaatcattttggtgttttacccatcgatatgtcacaatcttccccgtgggcagaacctgaaaaaagggaagagtcatattagctaaatgctgcgcctagcgataagtcaaaattcaccctgtaagcagggactagacagaagatagagttacatcatctggtggctggtgcagggatacgccaccatgccctctctaggcaggatccagacaggagagctatgttgcctgtgttttggacccaaaaatatgtcacaaacgcccatggacagagcacaggaaagacaggcacataacctgaatatcaggttcagtggtatgtcccaatgcctcctgtgagcattccaaggcaggagaggagactcacattacctgtgtgcaagacccagtgatacgtcacacggaggagtaccactgtcttgcatattgtgtaaactatggtagagaaattgtcaccaaagggctcagcacactggtgagattatacttctcagattcacaccacaccaatattcaggatggtctctatcacatgtggagagagcccactcttgaggtcctgaattacacatgcagacatagtccacaactgggattctgactttcatatgtgaacatccagccacaggtgggatggtgactcatttttaaacgcagctcataggcagttaagaactcttatttggacccatccaagtagaaagatgttgactgtcataccagggcttaaagctaaaggtacaaggaggggtccgtgcctgcttaaggtttcagagagaattgttacactcatgcatactctataaaggcttcatatggtgaagagagtgtcctgctagggcccagaacaaaggtgagattgtgatactcatatgtacactgagcgaagagcaaaaattgtcatcttttcacatgaacacagcccaatgttaaggttccgaatctcacacctgttgatctacctgctgatggaatagtctgtcaagagaaagcagagatgcacgagcatcaatctggaaaacagcaataatggtagtgtgcaccaggattcagatatcttcctagtattgttttctccaaacctctttattcgtaattcaccatttgtttcattgccattcgggcaactaggtagtaagaccattttctgctaagcaagagtaggtatacaagtaacaaatccctctggcctcctcctgaatagttcagagaacagattctagttcagccagctggctgctaacacccctcccttcctcagaaatgcttatgtttttaacaggattataagccacggcctcccagcatcgggtcccatcaatatatttggtggaatcatcagcaaaccaagcatgtctctgatcgtctgggcttggttctttaaaggatttgccccattgggcaggggaggtttccttccttatctgcaggacttgctcagtggtttgctgagctggcaagttttgcacatcctcatttaaaaatgatacctgttttggttccggcttagcctggtcttgtatgtgccatttccatttactttcttgagtgtaccctatccaatgaggtttgagggagttcatgacccaagtcatattaggaatttggggcctcataaaaacatcatgattaagacaaaggtgttctgtttcctgtaaagcccagtagcaggtcaacagctgcttctcaaagagtataagctttgctagcctctgacagcttctgggtctaaaaccccaaaggtatctcttcccatcttgtttctacctaaggctccaatgagcgtgttgatctaggacagttacttgcagttctactggcccatcctgtaagggccatactgttgctctgcttgtttggctggttgaaaagccacgctcactttctgtcttcagtgaaagtcatagcgttttctagtgactgcatgcagaggttgtaaaatgttacccaaatggggaatatgatgtctccagaatccaaacaaaccaatacaattttggacctccttttcagtggtagggctgcaaattctagtattttagccttagcctttggtaaaatggactgtttccctgcattccataggatgccaaggaactttacagtttgtggaggtccttgaattttactagggttaacttcccatccttgagataggatttgggtttttaccggatccaagccccagctgactagttcttcagttttaccctgactgggccactcaggcagctgcttttttcagcaataggctgataactttgaggctgatcagtcaagacataggcctggccatgggccagggccagcctggaagtcagattagcattttcttttctggcttacatttctgttgtagcagctgattcctatcttgacacattaacttataagcagtaagcaagcaccatccatgccgggaaattctctcagcatcccatttaccaactgggattccctgcacctcctcacacacagccaatgattcaaaatgcactaacttagattgcctattttcacaaacgtcagctcccttggaccactgaatggccaaggggaagaactaagggagttcccatctgaagatatggaaagtccccgagctcccagtctggtccctgcaccaaaaaatggcatgcttttgctttcggatcctgttcgtgaagccaaaaatgttctgcgcaggaaatgctcaaggagagaaggaaacacacacacacacacacacacacacacacacacacacacacaatacctttaagggtaaacaaactgtatcccacgtaaatggcaatgcagatataataagcaaatgatataataagcaagttgcaatgggacggagagaagggaaaagagatatatatatttacactcatcagactatggaggattcaccaccagactgcgaagcaacagactgggctccagagttggccacttgtccgtgaacagatgagaagagatctcatgaagttttggcacagtctggaactctagctctttttgtaatgagttatctggcatgacgtccagtcaggagggcccttcatttctgggctcaaggaaaagaaaaaggtcaacttgtttttttgattgtctgttgtttttcagtaactaacatataggaataaattgaaatagagatttatccgaaacagcgctggatgaaagcctcaaggggctcacacaacctgttccaggacttggtgaccattgtttgagtccagattcaattgagttcaaatttaatatttaaattttactccacaaagtgtcaaaagtaattccttcaaatgcaggaaattatgtaactactcacaaactaaacttctcaaccaaaagtcataaattgagtataggaattaaaaaaaaaaagaaagaaaatctaactacatctgtctaaagggactcaatttatttatttatttattttagagacttggtattgctttgtttcccaggctggtctcaaactcctggtttcacgtgatcctcccacctcaatctcctaaaatgctaggatgacagatatgagccatcttactctatagtaacaaaaacagactaaatgtggcaagatgcatccaaaaaattatgcaaatcataaccaaatgaggacagactatgtcacaattatagtatgcaaaatgctttttaaataactgtcttagtttataaaatatattatgaaatcaaattgtcagaaaaacaaaggacaaaataataaaagggtttattcactggaaacctatgacaattatacacatttacataattgtgtgtatatatctaattatgtattcacaccaatatgtatgcaccttacatgagtatttttaaatatctcaataatatcttgacagaacataagcaaaaacggcaatatattaaaagtataatattttaatacaccagttctgtaattaataaaaaagccagatagaatattaaaaagtaaacagacgacatgaaaatactgtaaagcaattagatataacagatgcatacagaacactctacacaaaaacaaaactcacaatcttctcaaaagctcatgaaacattctcctaaaaataactatgaagccaaaaaacaattctgaacagaatttttgaaaaattgaatgttacaaaaaattcaaaaaatcaatgaatataggagttatttttttgaaaagatcaacaaaatagactgctagcaagactaataaagaaaagagagaagaatcaaagagaagcaataaaaaatgataaaggggctatcacccctgatcccatagaaatacaaactaccatcagagaatgttataaacacctctacgcaaataaactagaaaatctaggagaaatgggtaaattcctggacatatacatcccccacaagactaaacaaggaagaagttgaatctctgaatagaccaataacaggttctgaaattgaggcaataattaatagcctaccaaccaaaacaagtcgaggaccagacggattcacagctacattctaccagaggtacaaaggggagctggtaccaacccttctgaaactattccaatcaatggaaaaagagggaatcctctctaactcattttatgagaccagcatcatcctgataccaaagtctggcaaagacacaacaaaaagagaaaattttaagccaatattcctcatgaacatcgatgcaaacattctcaataaaatactggcaaaccgaatcaggcagcacttcaaaaagcttaaccaccaagatcaagtgtgcttaatccctgggatgcaggttcaacatatgcatatcagtaaacataatccatcacataaacagaacaaatgacgaaaaccacatgattatctcaatagatgcagaaaaggccttcgaaaaaattcaacagcctttcatgctaaaaaatgctcaataaactagatattgacagaatgtacctcaaaataataggaactatttatgacaaactcacaaccaatatcatgcagaatgggcaaaaactggaagcactccctttgaaaaccggcacaagacaagaatgtcctctctcatcactcctattccacatagtgttggaagttatggccagggcaatcaggcaagagaaagaaataaagcatattcaactaggaaaagaggaagtcaaattgtccctgtttgcagatgacatgattgtatatttagaaaactccgtcgtctcagccaaaaatctcctaagctgataagcaacttcagcaaagtctcaggatacaaaatcaatgtgcaaaaatcacaaacattcctacaataccatacagagagtcaaatcctgagtgaactcccattcacaattgcttcaaagagaataaaatacctaggaatccaacttacaagggatgtgaaggacctctttaaggagaactacaaaccactgctcaacgaaataaaagaggacacaaacaaatggaagaacattccgtgctcatggaaaggaagaatcaatattgtgaaaatggccatgctgcccaaggtaatttatggattcaatgtcatccccaccaagctaccattgactttcttcacagaattggaaaaaactaccttgaagttcatatggaaccaaaaaagagcccgcatagtcaagacaatcctaagcaaaaagaacaaagttggaggaatcgcgctacctgacttcaatctataatacaaggctacagcaaggaaagcagcatggtactggtaccaaaacagatacatagaccaatggaacagaacagaggcctcagaaataacaccaaacatctacaaccatccgatctttgaaaaaaactgacaaaaacaagcaatggggaaaggattccttatttaataaatggtgctgggaaaactggctggccatatgcagaaaactgaaactggatcccttccttacactgtatacaaaaattaagtgaaaatggattaaagacttaaatgtaagacctaaaaccataaaaacttacaagaaaacctaggcaataccataggcatggacaaagacttcatgactaaaacaccaaaagcaatggcaacaaagccaaaattgacaaacgggacctacttaaactaaagagcttcttgtaaagggcccgctaggcatacccaaagcgggcagaaggctcctcaggggaaggtaaggtttgagggagtgcaggtgaggcacctgtggcagaaaaaaaaaaacgcaaaacaaaaaaaaaaaattcgccgccaagaagcgttcctggttcccccacggacgaaagtgccttcccatcagtccctgcactgggccttggatactctggcgtccctggttcgaacccagggagcgactcaggcccgctaggggtaccccaaagcgggcagaaggcccctgaggggaaggttaggtttgaggaaagggaggtgaggcacctgtggatgaaaaaaaaaaaaagaaaaaaactcagcgtcgagacgcattcctgggtcccccacggaagaaagtgccttcccatcagtccctgcgctgggccccggtgaccctggcgtccccggttcgaaccaagggtgcgtctcgggcccgctaggggtaccccaaagcgggaagaaggtccttgaggggaagttaaggtttgagggaggggagatgaggcacctgtggcaggaaaaaaaaaaaccgcgccgccaagaagcggagactgggtcccccaaggacgaaagtgccttcccatcagcccccgcgcatggccccgtgaacctggcgtccctggttcgaacccagggtgcgtctcgggcccgctaggggtactccaaagctagcagaaggcccttgaggggaaggttaggtttgagggaggggaggcacctgtggcaggaaaaaaaaaacaaaccgagccgtcgagaagccgagactgggtcccccagggacgaatgtgccttcccatcagcctctgctctgggcctggggaccctggcgtcactggttgaacacaaggagcgtctcgggcccactagggatacctcaaagtgggcagaaagcccctgcggggaaggtaaggtgtgagggagaggaggtgagtcacctgtggcacaaaaaaaaaaaaaaaaacgcgccaccgagaagcgttcctgggtcccccacggacgaaagttccttcccatcagcccctgtgctggaccgcggggaccctggcgtccctgcttagaacccacgcagcgtctcgggccggctaggggtacaccaaagcggacaaaagccactgaggggaaggtaagctttgagggaagggaggtgaggcacccgtggcaggaaataaaaaaaaaaagcgccccggagaaccggggcctgggtcccccacggacaaaagtgccttcccatcagtccctgggttgggctccggttaccatggatcgccggttccaactcagggccctctcgggcccgctaggggtaccacaaagcgggcagaaggcccctgaggggaagttaaggtgtgagggaggggtggtgaggcagctgtagcagaaaaaaaaaggaaaaaacagcgcgcctccgagtagcgttcctgggtccttctcggaagaaagtgccttcccatcagcccctgcgcatggccccgggaccctggtgtcccttcgaacccagggagaatctcggcccgctagggtttccccagtgcgggcagaaggcccctgaggggaaggtggggtttgagggagggaaagtgcagcacctgtggcaggaaaaaaaacaaaacagaactcgccaccaggaagcgttcctgggtcctgcacgcacgaaagttccttcccttcaatccctgcgctgggacccggggaccctggcgttcctgattccaacccagggagggcctcgggccagctaggggtatcgcaaagtgggcagaaggcccctgaggggaaggttaggtttgagggaggggatgtgaggcacctgtggcaggaaaaaaaaaaatcgcgccgccgagaagcggggcctgggtcccccatgcacgaaactgccttcccttcaacccctgctctgggtcccagggaacctggcgcccctgattcgaacccatggagcttctcgggcccgctaggggtaccccaaagcgggcagaaggcccctgaggtgaaggtaagatttgagggaggggaggtgaagcacctgtgtcaggaaaaaaaaaaaaaaaaatcaaccgcgctgccgagaagcgttcctaggtcttccacggacgaaagtgccttcccatcagcccctgcacatggccccggaccctggttcgaacccagggagcgtctcggtcccgctatgtgtaccccaaagcgggcagaaggcccctgaggggaaggttaggtttgagggaggggaggtgagtcacatgtggcagggaaaaaaaagaaaaaaaaagaaaaaaaaacctcacagccgagaagcggggcctgtgtcccccatgcacgaaagtgccttcccatcagccctcgctcacagccccgggaccgtagcgtacctggttcgaaaccagggtgcaaacaaaactattatcagattgaacaggcaacctacagaatgggagagaatttttgcaatctacccatctgacaaagggctaatatcaggaatctacaaatagctaaaacaaatttacaagaaaaaaaaacaaccctatcaaaaagtggggaaaggatataacagacacttttcaaaggaagacatttatgcagccaacagacatatgaaaaattgctcatcattggtcatcagagaaatgcgaatcaaatccacaatgagatatcatctcacgccagttagaatggcgatctttaaaatttcaggaaacaacagatgctggagaggatgtggaaaaatagaaacacttttacactgtgggtaggagtgtaaattagttcaaccattgtggaagacagtgtggtgattcctcagggatctagaaccagaaataccttttgactcatcaatcccattactgggtatatacccaaagagttataaatcatgctactataaagacacacacacacatatgtttattgcggcattattcacaataacaaagtcttggaaccaacgcaaatgtccatcaatgatagattggattaagaaattgtggagcatatacagcatggaatactatgcagccataaaaaggatgggttcatgtcctttacagggacatggatgaagatggaaaccatcattctcagcaaactatcacaaggacttcaaaccaaacaccgcatgttctcacttataggttggagttgaacaatgagaacacatggacacagggcggggaacatctcacattggggcctgtttgggggtgacggactatgaaaggaatagcgttaggagaaatacctaatgtaaatgatgagttgatgggagcagcaaaccaacatggcacatgtatacctgtgtaacaaacctgcacgttctgcacatgtaccctagaacttaaagtataataaaaaaattgaatgttacatactataatttctgaccaaaaaggattaaaactagcaatcgataacagaagaaaattcatacaattcacaaatatgtaaaaattaagcaatttactcttgaacatgcttttgttcaagagttagaaaacttactattttgaacatgtctataatgccaaaagtgacctacagatttaatacaatccctataaaattcttaattttatttttgacagatacagaaaatgtgactcccaaaagtatatggaatttcaggagaccacaaagaactctacagttttcaaaaagagaaaaattttggaaacattacagttcctgttttcaaaacctgttacaaatctacagtaatctaagtagtttgttactggcataaagacagacaaatagactaataaaaccgagtgcaaaaaagatgtaaacgctcacgtatttattgtagctttacttacaaaaatcaataggttaaagcaatccatacttccctcaacaaacaaatgaatgggtacaatttggaatataaaaacaatagaatattacccagcttttgaaaagcagaaaaccttttatctataataaaaataaaatcttgatgacattatgctaaataaaataagccagctacaagacagatactgagtgtatccacatgtataaaatatctaaagtagtaacatccttagaaacagagaataagatagcatttgtaaagggctgaacaaaggagaagacaggcagttgtttcaggtgtattgagttttagttttgtaagataaaaatgttctagagatacgtcgaataatgtcaatgtgctgaaaagtctaaactatataattattgtcattgtaaattattgtaaaattgtaaataattgtcaattttatatgtttcttataacaatgtaaacaataataatatctaagtgagataccgttttaatgcatttcaataattatcttcaggacctcggcaaaacctgagtcctgtcctctcgctttcctccccgtacacagcgagcttcaccacttgctccgcaccttctccatcaactactacctgtccctgggatctgtccagtcgcccagctaaagtgctcagcaggtcagcagcgcggcgagcttctatgaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaacacccacaggatagtggacggcaaagtggtgtttgagaccaacatcacagacgtcttgaggtgctaaaccagcagaagcaaggtccctttgcggagcaggagggcaataaaaacttctgtggtcaaaaaaaaaaaaaaaaaaaaaattacccccgcatcacagaggtgttttcctcacgcaaacgtaatatagattcattaatacatagatgtggaaattagggcaatttccacaactactcacccagagaggattaaaaaaataattgaccaccaactaattaaataaatacagaagtcataaataaagcatgagtaatgtttatacagtcaaacgaacagagaattatgtttgcaatacacatatggttgattcatatttgactttttttctacactcttttaaagtgtacacagttaaatatagtcataaaaaattataacatataagcagaaactaaaaacacaattaaatgatgtaagacagcctatcctaacaggaaaatacaggaatataaaatattacaaaacaaaattggataaacattaacctgtgaaatactgaataaacaaatcatgcaactgaagaagactctttctagataactgaaatattcaaccataactggacacccataaagaacagattttgaattattagcatatggttagagtaacaaaatttcacaacaaatgcattataatcttctataaagaacatttagaagaaaattttaatgaagatttcaatgatattagagaacagagtctcgctctgttacccaggctggagtgtagtggcgagacctcggctcactgcatcctccacctaccaggctgaagcaattctctgccccagcctcccgagtagctgggattataggcacccgcccccatgccctgctcattctttctgtggtttttgtggagacggggtttcaccatgttggccaggctggtcttgaacccctgacattgtgatccacccacctcagcctcttaaagtactgggattacaagcgtgagccaccgcactggcctataatttgtttttttttttaagtaaagaaaagctttacatttttaaatatgggaacaacatgaatactgaaaaatatgcaatgaaacactactacataataagcaatgagaaataaattatactatcattcagataatgttgaggaaagttaatagaaacactaatgataagtttttctatgcagtaaacttagacacacaaactgaaattttattaatgtgaggtgcatactaagtaattcactttttatataacacataaattcaagtatgctattctgaaatccctgaagctaaaattataggctaatttgggatacataaaaatcaaaaagtgaaaacgtgcagatcacagtcccactaagctttatataagattaaataataaaataactcaataagaaatcatgtaacaattaagaatttattctattcttggcaggtttctaagtttttctatggcattaaggtctttaaaaattctttgaggtgagtagatacaataaactattccacaggtgaggtgcttggcatagagagttcacgtttttaagttaatttctaccaaggaaaagaaaactttttgacctacattaccagagatgaaaaaaagaataaagtgaaatagaagcttcactatatcatatgtgctgaggtgttttgggctctgataaaagtttttccgatttttttgcaggatcacatttgaaatcataggactgaaaattatgaagcagaaacatttgtccttggtgtttctgaaatatgtgaaccaaaccccaatgcctgcacttttactctcacaaacttctgacatgaggaacagatttttacaaaatagcttaatatagaagtctcgcaaaatgtgcagatttccccagatcccccaaaacaatggaaaagcactcagaccacaaggccttcaagggaataacagaaagaagaggagaacttcggctgtcactgtgaatgccctggaatgttagtggagggacaggaggagccttagaagatttaggagcataataagcatagggtaggaaatgtccatctgtggcagcaaaagaagtaaatctaggatcttccagaaccaatttcattgaagcgaacttcccacatcacatttttaaagtttcctccttggcctttgcacctctcatctttgttatttgttcattattgcctattggggtgatgcctattattttctctctttttacattccaaagatatttcctttactgtagaacaggggcatccaagggagaatctcaccacgaccccaggtctagagcgcccggagtccgccatccctgggaatggaggcggcttcggcctggggtcgtggtgagattcgttggtggctgcgcgattgtggcggagttgcaagcaaacgggtttcatcaccttaaatggttttgaaccaaagaagctgtattcccttaaaaagacggacaacccatcgtgtgaactatagagtttgtgaacaaatttatattgggttcatagtggcgtcatgcacgcagactcctgcgagttcccctaagttcttagaggactgctttgccttttgatctgagagttgcaaatttccctaaagaatggcccttgtggataagcgctaagtcaagagacagtgattggacagaatttgtgaggaattcgcccccagatcatgaaagtcaccctgaaccccgcctcgtggtggctctgctggatggacgggactgcactgtggacatgcccatcctgaaggacctggccacctggccttctgtgaggctcagtccatgcaggagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggttgcagttcgagccaaggcctttgcaggatgggatcgagcggtccctgggtgtgcatagggtctacacccagcaggatttgctgtatcagaacgactgcgtcttcttgcattgcaatctcaacgaacaaaactaccaccttatccatgactttactataaagcagatgaggcagggagcattccttgtgaacgcagcccgtggtggcctggtggacgagaaagcctgagcacacatcctcaaggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggtccgtaataaaccagcaagaaattcatcctgagctcagtggtgctacctacagatatctgccaggcatggtgggcgtggctccaggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcagagaatgccggaaggtaattattcagatatacttgggaacagtgaaaaatagataatctaagagaaaaagaatctgacggcctttttagctgattccggacatatgcatcattgttgttgcagtgttaaaacaagagctagaaaactgacaatgtcgtctgcttacggaagctctgaaagactagggtgtgatttattaacgcccaacttctattattgtgtgttaagtttttcatctgtgcatcaaatcacaaagaataaatagaacttttccctttatcagtcccttaggcacagcaggtcctgaacaccctgcttatatgttgcatcagcagttcaaatatgaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgcaaaaaaaaaaaaaaaagtattaagtttcacaagttgttagtaatcaagtatattttctcagtttcagatcctctgcgattttattgagtggaaagtcttgcgctgaaagggttcaagaaaaataatattgcatttccttatgtcacaggaaacacttttaatggtaacttgtcagactatgaacaaacccactttttaagatattgataaagtcttcttttcttcacgtgatattttatacaagtacacttcagatgtattggatgtggctgattttaacaaatcctattagatttgtatcaattagttacatgttctattcatagtcttttgtgaatcattgcctttttgtttaaaaagatggcctattttgagcctttgtataagtacattcctgtttttgtgacaaaagaaaaactttaaatttgtcccaaagagaaaaataatggctatcagaagtatgctttgttttagtgcgagttaccgttactgtatttgtgtattgtaaaggtggacattctaattacattaaaatgtaattagaaaaaagtgcttaatgaacaaaaacagaacatagacaacaaaagaatattagaagtgatgcatgaagaaaacgagatatcaataaaaagatttttaaaaaccaagaaaaattgtgactctgaagaacacagtaactatattaaaaatttaatcagcagtcacaaaagtggatttaataaagcagaaaaaattagacagttgataacattgcacttataaatactgattcatgaaaacaaattttttaaacagaatagagaaaaaatgaaaattgggacttacttacagcacaccaccaagtggaccactgtatttataaaaggagtcttagaaaaacagtataggagaaaaataataaagaggatatttttaaaaagtagctgagaactccctagatgacaaggtaattaaacaagaagaaatcatgctaaacaaaaaccttcaactggaataatttcacttcagaaaaaaaagttaagcatttccaaaacaaataaaagttgagtgtgttactgaccactggaacactgctaaaggaaatgtaaaagaaagtctatcacgtccaaaaatgacaatatatgctgcacagcgtcataaaagcatatgaaaatagaaagctctctattaaatgtaaatacataaacagctatagaaacctctactgtcataatgatggtgcacaaaactttcacgttattgctatggaatttaaaaaatgaagcagaaagctgcataaatatgggttcatagatactcaataagaaaagataacaagtgatattaataacaaagtgggggtataaagaggtaaagctttgcattccattgaaatatagtcattatatattgtcataactttaagatgttttatgaagtctttatttctcaagatgattacaaaaaaacctgtagatggtatgcagaagcaaatgagaaagaaactgaatcatgtcactacaaaatcaatgaagaaaaataaagcagtaagagaaaaaaatgataaataacacatctacaagaaacacagaagacaattccaaataataatagtaacttcattaactacagtaattacttcaaatacaaaaagttaaataccttaaacaaaatgcagaaaatgatttaatggattaagaacaaagaagatccagcaatgtactctctacaagagtcattttagctctaaggacccaaataagttgaaagtagcagtataaagaaaatatattttatgcaaagagtagctacaattggaggggcatggtcataattatattaaacaaaatatattttaagttaaaaattttaaaaagagacagattgttattaagtaacggtgacatggattaacttgcaagaaatccataacaataatttagaaatcatatatataatttgaaaaatctgcaaaaatataccattgggattttgataaaaattacattaaatttttatattactataaataacactgatatctttcttatttttttttttggagatagagtttctgtctcccaggctggaggacaatggcacgatctcgcgattggctcacttcaacctccacctcccaggttcaactgattctcgtctttcaaatatgtaaaaccaatattgacagaagtcaagcaagaaatatatagcaacacaacaattgcggactccaagactccactttcaataatgactagaatagtcagatgtaatatcagtaagaaagccaaacctgaacattatagacctaacaagcatttacagaactctgcgatcgaaagcagcaaaatatgcaatattctcaatcacacatggcacattctgttaggatacatgtcttattaaatttaagaaaactgaagtcatgcaatgtaaatgaaactagaaatcaaaagcaagaaaatgtttcagatacgtaaataagaggaaattaagcaagatcttacatatagtcttgctcaagtgtcaggtgatttaatattgttaagatgtcagggccggcacgtgactcatgcctgtaatcccaggactttgggaggccaaagtgtgtggatcacttgagatcagaagtttgagactagcctggccaacatggcaaaaccctatctctactaaaaatacaaaagttagctatacatgttggtgcatgactgtaatcccagctactctggtggctgagactggagaattgcttgaacatgggaagcagagcttgcagtgagcacagctcacaccactgcccttcagcctgagtgactcactaaaactccatctccaaaggaaaaaaaaaaagttgtcagtattacccatgatgatataaaaatgtaatgtaattttcatctaaatcccaatggtattttttttgcagaatttttgtgtataattctaaaagttgtttaggaactgtgactaggcaaacaccctttaaaaaggacaaagagttattacattttctgatttaaaatcatgatacaaagctacaaaaataaaaacaatatggtattgccacaaaaacggatacatagatgatgaaacagaatagacatcctggaaataaaccctcgcatacgtgataaaataatcttccatatgctttccatgaccatgcaatagaaaaataagaatctctttaacaaagaattttcaaaattgaatgtttacagagcaaaaataaagttggatgcttcttttgtattatacataaaaagaaaagttgttttataatggatttaatgcttaaacataaaaactaataaaattcttagaagtaaacataggggaaaagtttatgacataagtcttaaaactttgcttaagtatgacatcaaattcataagaaacaaggaaaagaacaaaaaagaaaggaactacattaaccttcaagtattctacacatcaaggaaaaatttagtggcatacaaatgtcacctaataagtgggtgaaacctgggcatgctggctcatgcctataattctagaaatttaggaggccaagtcagaacgatcatttgaggccaaaagtttgagactagccatgaaaatatatcaagaccctgtcttgtatagggtaatatatgtgcatacatacatacatataacaaaaaagtgtaaaaatattttctaatcacatatttcgtaggtgttaatttccaaaagatataaacttctaaaattcaacaacaacaaaatgttaataacttgatttagaatggtaaatgtttgaaatgacctttctccaaagaagacatagaaatgactaggtatttaaaaggatactcgtccgagggcaggactatgggaggctgccctgtacggaaaataagaagaaatggcagtaaagagggcaaccatcattccacccagcccaaaaggaataagagaaaccctatctttcaggattctcaagacacagttttcatggagtgataatgaaaggagcagcagccgccttaatatcccagagagagcaggtggaccagaaagcaacttaaaccagattgttactgaacccaatgcaaactttccccagttcttgcatgaggggtatgtaccatgccaaggtctttactcccatatcaaccagaccttgaaggaggctcacttcaacagcctgcagcagtgagggcaagctccaacatgatgaattaggacttccttattccaacctaaactgtgtttataaaagtaattgcatacaaactaaaaaaaaagtctattggtttttaagtctaaattttaagtaacaagttaatgggcagtagtttaattggggttttacttcactgctatacttttaaaggggctgtgaataaatgtttatgaaattaaaaaaataaaaaataaaaggatactcgacatcactcttctagaaaaatgcaaagcaaagtcacaataatctacggcctcaagccgatatttaaaatagtatgacagctcttcaaaaaatttaaaatgagattattatataatccagcaaacccccttctggctatgtacttaaaatgtacaacgcagatctggaagagatatttgcacaaccaaatttattgcaatattattaacacaagccaaaaggcagaaacaatccagatgtcccttgaccaatgaacagattaataacaagtggcacatacacaaagtcgaatattattcagtctttaaaaagacacattatatgataattctggagaagatcatgttaattgaaataagccaggaacaaagtgacagtctatgattccattcataatcaggtatcttaagtagataaactcataggaaaaaaaagttagaatggtgcttgtcaaggactgaagagatggtaaaatgggcagttgttttattttttatttttttattttttttatttttttaaattatactttaagttttagggtacatgtgcacattgtgcaggttagttacatatgtatacatgtgccatgctggtgtgctgcactcactaactcgtcgtctagcattagttgtatttcccaatgctatccctcccccctccccccaccccacaacagtccccagagtgtgatattccccttcctgtgtccatgggatctcattgttcaattcccacctatgagtgagaatatgcagtgtttggttttttgttcttgcggtagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtataaaagtgttcctatttctccacatcctctccagcacctgttgtttcctgactttttaatgattgccattgtaactgatgtgagatggtatctcattgtggttttgatttgcatttctctgatggccagcgatgatgagcattttttcatgtgttttttggctgcataaatgtcttcttttgagaagtgtctgttcatgtcctttgcccactttttgatggggttgtttgttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgtcattgcttttggtgttttggacatgaagtccttgcccatgtctatgtcctgaatggtaatgcctaggttttcttctagggtttttatggttttaggtctaatgtctaactctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtaaccttgtagtatagtttgaagtcagatagtgtgatgcctccagctttgttcttttggcttaggattgacttggcgatgcaggctcttttttggttccatatgaactttcaagtagttttttccaattctgtgaagaaagtccttggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcttaggtattttattctctttgaagcaattgtgaatgggagttcactcatgatttggctctctgtttgtctgttgttggtgtataagaatgcttgtgatttttgtacattgattttgtatcgtgagactttgctgaagttgcttatcagcttaaggagattttgtgctgagacaatggggttttctagatatacaatcatgtcatctgcaaacagggacaatttgacttcctattttcctaattgaataccctttatttccttctcctgcctaattgccctggccagaatttccaacactgtgttgaataggagtggtgagagaaggcatccctgtcttgtgccagttttcaaagggaatgcttccagtttttgcccattcagtatgatattggctgtgggtttgtcatagatagctcttattattttgaaatacgtcccatcaatacctaatttgttgagagtttttagcatgaagggttgttgaattttgtcaaaggttttttctgcatctattgagataatcatgtggtttttgtctttggctctgtttatatgctggattacatttattgatttgcatatattgaaccagccttgcatgccagggatgaagcccacttgatcatggtggataagctttttgatgtgctgctggattcggtttgccagtattttattgagggtttttgcatcaatgttcatcaaggatattggtctataattctcttttttggttgtgtctctgcccagctttggtatcagaatgatgctggcctcacaaaatgagttagggaggattccctctttttctattgtttggaatagtttcagaaggaatggtactagtccctccttgtacctctggtagaattcagctgtgaatccatctggttctggactctttttggttggtaaactattgattattgccacaatttcagatcctgttattggtctattcagagattcaacttcttcctggtttagtcttaggagagtgtatgtgtcgaggaatttatccatttcttctagattttctagtttatttgcgtagaggtgtttgtagtattctctgatggtagtttgtatttctgtgggatcggtggtgatatcgcctttatcattttttattgcgtctatttgattcttccctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagttgaattgcactgtggtctgagagatagtttgttacaatttctgttattttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatctttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgcattgatccctttaccattatgtagtggccttctttgtctcttttgatctttgttggtttaaagtttgttttatcagagacgaggattgcaacccctgcctttttttgttttccatttgcttcgtagatcttcctccatccctttattttgagcctatgtgggtctctgcacgtgagatgggtttcctgaatacagcacactgatgggtcttgactctttatccaatttgccagtctgtgtcttttaattggagaatttggtccatttacatttaaagttaatactgttatgtgtgaatttgatcctgtcattatgatgttagctggttattttgctcgttagttgatgcagtttcttcctattctcgatggtctttacattttggcatgattttgcagcggctggtactggttgttcctttccatgtttagtgcttccttcaggagctcttttagggtaggcctggtggtgacaaaatctctcagcatttgcttgtctgtgaagtattttatttctccacttatgaagcttagtttggctggatatgaaattctgggttgaaaattcttttctttaagaatgttgaatattggcccccactctcttctggcttgtagggtttctgccgagagatccgctattagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccctgctagattgtggaagttctcctgaataatatcctgcagagtgttttccaacttggttccattctccccatcactttcaggtacaccaatcagacgtagatttggccttttcacatagtcccatatttcttggaggctttgttcatttctttttattcttttttctctaaacttcccttctcgcttcatttcattcatttcatcttccattgctgataccctttcttccatttgattgcatcggctcctgagtcttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagctcagaggaatttgatcgtgtgaagccttctctcagctcgtcaaagtcattctccatccagctttgttccgttgctggtgaggaactgcgttcctttggaggaggagaggcgctctgcgttgtagagtttccagtttttctgttctgttttttccccatctttgtggttttatctacttttggtctttgatgatggtgatgtacagatgggttttcggtgttgatgtcctttctctttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgctggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctctcccagcctcgctgccgccttgcagtttgatctcagactgctgtgctagcaatcagtgagattccgtgggcgtaggaccctccgagccaggtgcgggatataatctcgtggtgcaccgttttttaagccggtgtgaaaagcgcaatattcgggtgggagtgacccgattttccaggtgcgtccgtcacccctttctttgacttggaaagggaactccctgactccttgcacttcccaagtgaggcaatgcctcgccctgcttcggctcgcgcacggtgcgcgcacccactggcctgggcccactgtctggcactccctagtgagatgaaccgggtacctcagatggaaatgcagaaatcacccatcttctgcttccctcaggctgggagctgtagaccggagctgttcctattcggccatcttggctcctctctcttgcttcactgttaaaggggtaatgttctatctaaaacttggagtcagctgatataaaagttttaactcttaagtggagatagggatgctatgtagcaagattgctgacctgcatgcatggcttaacacttgccttgcactgccttaaattgtgacaataatttggtattatattgccacagagtcagttttgtcagtcttatgatctctattttaacattagtgctgatgatttgttgtacctaaagagcaaacagaggtacaacagcaaacaggtgtgtaacaaggcctgtctgtctcctcctgttctgtgtgggagatgctgatgggagaagaaaagacacacacacaatacctttaagggtaaacaacttttttatcccatgtaaatggtattgcagatatctatatctatatctatatttttatctatctatatatatgtatgtatgtatctatctatctatatctatatctatgtatatgtactcaccagactatacagcattcatggccagatggggaagcaacagcctaggctccagagttggctactacacccaccagactatggaggattcacttttcagcttcaagatcaccgctggaagctcagggacttcccatattccaggatagaaactcctccagttctccctcttggcaattgaatggtcggggggaactgaccttagtgaaaattgggtatctaaattagtggaatttgaacctttgactgtgcatgaagtgctgcaggggatttcagtcagcaaaggagatgccagggggatctcttagcatagatggtgcttgcttactgcttataagttaatgtgttgagatagaaatcaattgctacaagataaatgtaagctggaaaaagaaaacactactctgacttccagactggccctggctcaatttcaggcctatgtcttgactgatcaggctcaaagctaacagattattgatgagaaaaacagctgtgcaagtggtgtggtcagggtaaaactgaagaacgagtcagctggggcttggtgtgggtaaaaacccagttcctatctgaagaatgggaaattagcctttacaaatttcaagaacctgcacaaactataaaattgctttgcatcccatggaacgcaaggaaaaagtccattttaccaaaggctatggttaaaatactagaatttgcaacccctaccactaaaaaggaggcccagaaatgtattggcttgtttgaattctggagacatcttcccggtttgggtaacatctcacaacctctgtatgcagtcactagaaaatataatgactttcactggaggtagaaagagaacacagcctttgagcaagctaagcaagcagtgcatctggccctggatggcccatatgggatgggacagtagaattgcaaataactgtcctggattaacatgctaattggagcctttggcagaaacaagatgggaagaggggactcttggggtttcaaacctggaagctgccagaggctggcgaagcttataatccttttgagaagcgactgttagcttgctatcgggctttgctggaaatggagactctctgcttcaaccatgatgtcttcataaggcctgaaattcctattatgacttgggtcatgaggtccaccaaaacccatcgaatagggcatgctgaagaaagtagcatcacataatggaatggtatatacaagatagggcaaagccaggaccaaagggggtatcatttttaaaaaatttgccaactcagaaagccaccgaacaagtcctgcaggcagggaaagagacctgcctcatccaaagcatcagaaacatgcttggtttactgatggatctgccaaatacattggtgggacccgatgcggggaggccgtggcttataatcctgttaaaaacataagtatttctgatgaaggaagggatgggagcagccagctggctgagctagtagccatcttcccagctattcagaagaaggccagagggatttgacacttgtataccaactcttggtcagtagcaaatggtcttactatctagatgcctcaatggcaatgaggcaaatggttaattgggaataaaaaggtttggggaaagaatacagggaagatatctgaatccctgtgcaccctaccattaacactgttatgttgatgctcatgcatctctgctttctcttggcagactaattaatcagcaggcaggtcaacaggccaaaatttccaccataactgcaaactcaaatgtggatgaacggattacaacacgtgcaagcattggaatgagaggcattatagtgtatggtggtgtaattgatagtgattaccggtgagagttaaaaatcttttaacacaataccaccgaaaattcttttgccataaagccgcagatgcagattgctcagctactggtagtaccgtgtcaccaattaacccccgaggaaatttctgccccaataggaacatcatatagaactggaggatatgggtccaccaaagtgggcagcttaaatcctggggccacagtatgggggcagaaaatgaggggagtagtaaaattttaaaaacaatgttatgttcccctctgtttttgttattaaaaggaatagcctatcgaatgatggtcagcacctgcttctttgtgtctgaggccaagaatgcatttagcaactgggtagccaccgctgcaaaagaagtcaactgcagttagagctgccttttagtcgaattgccacaggctgcagggaatgggctcccttaaaaaattgtctctgccaacatttccaagtggttacatcactaccaagggggtcaggagaatagcacctgtaatcccacctggacttcttttaaccaaatcaaagagtctatttttgcccaagtctgacaaaaggagaaatccacttttgcaatgcatcaaaggcctttgtatcctacccaatatacttggaaagacatatacagggaacctaccataccggtagctgaactccatatggcaccgcacccccgctttgtctggaggccttaaatggctcttttaatgttactctggggtttctcccaccagacaattgtcaacacatactccaaatcaacagcattgtccccaatgaaacacaacctctttcctaaatctagatgcttccaaacatcactggttacaaatgcgccagaatccctgatggggtgtaccctataacagtgttctcctctgccactgatacaattctgtttcagcaaaaaatttaaatattaagcttacatgtagaaaaagctcttaatggtagtagcactggacttatgttgttatcagaggaatttgctcagttgtgtactgttgtgttgcaaaatcaaatggcattaggtatgcttaccgcagcccaaagagcgtttcagccttgctgcatactgaattttgtgtgtgtatccctgacagttctcacaatattactctcctcgcccaagacatgcaaggacaagcaaaacaaaatctaactgtcaggaccccatcatgaattggctgtccaactggcattggcgttggccttggtgggtgcggtttttattaactgtgttttaattctcctctgcttaccctgcttctgtaacctctaccaattatgtattcctcgtatatctgtaagcgtattttcttacatttgagtatcaattgggacagaatacgcagaaaaagttaaataatatatttaaactcaattgaacatggacacaaataatggtcaccaagtctcggaataggttttgtgagccccttgaggcattcatccagcactgtttcagagaaatctctatttcaatctattcctatactttagttattgaaaaacaacagacaacggcaaaagcaaattgacctttttgtgttcctttgtgcatggatgagtggctgactctggagcccaggctgttgcttctcggtctggtgatgaatcctccatagtctatcctcatatatatatatacacacacatttttttccttctccccttcccactgcaatttgcttattgtatcaatttgcttattctatcatttgcttattatatctgcattgccatttatgtgggatcgagtttgttgacctttaaaggtattgtgtgtgtgtgttttcttcttccctggagcatctcctgtacataacacctctcttgctgtcatagccagaaattcagtttttaagtttttttctggggtcttcttgctcaagaggaagtatgttcagttgatacggggcttagaattttatttatagcttttattacattctaaaacccccagcagaaacaagtcttaacaaacacagattttaatttctgaacattcttctaataagttttgcacaggtagcggaacaactaaaaaaactgttttttgcattgatggtctacctcattacaatttaacctctaaagggtgttttagtcagctctagagtctgctacggttaaggtgaatttactgcttcttcccataataaagaatggtattttaaaataacataacttctatggcatatatttttaaagcatgaccacaatttgaataattagaacatttaaaaattcgaaatattgttatactgacactgcaccaaaatttatccttccaatgatgacagggaatttttaatagttgttatttttatagtaaaattaaactttaataaaataactgacttacaaacttcagcaagaagacacatattcagccagagatatcagttcccctttagaaaaaaatactcacttctcattaaaatctctctgtatcttactgatttcagatagaatttaaatttcaccttaataacagaaacaaaagaactagttaatctaacaaaaactaataaacgtatgcccaaatttactggcagaatcatgggtacgtcatataatagtaacattctaccagttttaagtaaaataaataaggaaataatcttaacagtgcaacctaccaggaggggcctatccctactcccaggtgagtgggaaccctgcgctctgggggggttgcgcctcagcctctggcacctcttgttggcagcgtcgccgttgcaggcacagggcaggcgttgggggacgtgcagtgggccaggcccaggcacgtcctttgccaggggctgggcaggtgcggagaggggcggagcggtgctgccctggtcgagggagcctccagctctggacagtttgctgcccctgccccagggggggttaaaggagctgagtggggaagcggagggacgaggggattcaggccaggccaggtggccctttagccctgggtgatgcaggaggggctgtggaagaccagagaagacccggagcagaaactgggaactgatatctctggctgaatatttgtcctcttgctgaagtttgaaagtcagttatttcattaaagtttaattttattataaaaatagcaactattaaaaattccctgtagtcactggaatgataatttttggtgccgtttcagcataataatctttggagtttttagatattctaattattcaaattgcggccatgtttcaaaatatatgccatataattttatggcattcgcctctgtgtccctgttggctcaggaaacgtgcttcttcctccttccgcagactcggatcaggccgcccttcctcctggcgtctgaggcgggcatggggacagcctgccagcgaatatcctgacaatgcccggcctgtgccctgtgctcagcgtggggtcctggttggtgcccctcagagcccctcacaaagtagcgcgacaggtgtggaaggacccagcacccggcagcggtgagcagatggatgctccagggatgtggggcagctggcagtcaagaacccactgccaaattcaatggcataacgttgcatatttttcccttatatttttgtgtaggagttttacagctttcagccttacatttgtattttcttaacataggattccagaacaatgctacgagggtctgaatgcctgtcccacacgtaggattccagaacacatcagctgtggtctgaatgattgcccctcacatatgattccagaacagtcctgctgtggtctgaatgattgtgcctcacacagggttctagagcactcctcccctagtctgaatgtttgtccgtcagacaagattccagaacactgctgctgggttctgagtgtttgtccctcacatacaattccagaacactgctaggtgggtctgaatgtttgtacctcacataagattccagaacactgttatgagggtctgaatctttgtccctcacgtaggactccagaacactcctgctgtgttctgaatgtgatttcctaacataggattacagaacaatgctacgagggtctgaatgcttgtcccacaagtaggattccagaacactccagctgtggtctgaatgattgtccctcacataggattccagaacactgctgctgggttctgagtgtttctcccttacataggattccacaacagtgctacgagggtctcaatgtttgtcccgcacataggactccagaacactcctgctgtgttctgaatgtattttcctaacctaggaatccagaacagtgctacgagaatctgaatgcttgtcccacacttaggattccaggagatgccagctgtggtctgaatgatggtccctcatataagattccagaacaatgctgctgggttctgagtgtttgtccctcacataggactgcagaacactgctacgagggtctgaatgattgtacctcacataggattacggaacactcctgctctggtctgaatgtttgtccctcagatgggattccagaacactgagtttgggatctgagtgtttgtccctcacgtatgactccagaacactgcctcatggttgtaaatgtttgtccatcacataggattccagaacactgctatgagggattgaaagtttgtcccgcacataggactccagaacattcctgctctgctctgaatgtttgtccctcagataggattccagaacacagcttctgggttctgagtatttgtccctcacataggattccagaacactgctacgtgggcctaaatgtttgtccctcacataggagtccagaacactgctgctttggtctgaatgtttgtccctcacttaggattccagaacactccttctgtggtctgaaagtttctccctcacaaaggattacagaacactgctcctggtttctgagtgtttgtcttttacataggattccagaacactgctacgagggtctgaatgtttgtccctcatataggattccagaacactactgctgtggtctgaatacttgacccttatataggattccagaacattcctcctgtcatctgggtgtttgtgcctcacaagggtttccagatctatcctgctgtgttctgaatgtttccccctcagataggattccaaaacatttcttctctggtctgagtgtttctccctcaaataggattccaaaacactgctactggagtctgaatgtttgtccctcacataggattccagaacactgctacgagggtctgaattattctccctgacatagcattccagaacactcctgctgtgttccgaatgtttgtctctcactcaggattccagaacactcgtgctgtggtctgaaagtttgtccctcacttaggattccagaacactgctgttggtttctgagtgtttgtacttaacgtaagattccagagcacagctacttgggtctaaatgtttgtccctcagataggattccagaacactgctaagaggttctgaatgtttgtccctcacatagcatttaagaacactgctacgagggtctgaatgttttccctcacataggatcgaagagcactgctgctgggatctgaatgtttttgggcacataggattccagaactctcctgatgtggtctttatgtttgtccctcacatagaattccagaacactgctgctgagttctgcttgtttgtccctcatttaggattcaagaacactcctgctgtgttctgaatgtgtgtctctcacataggattccagaacattgccaggagggtctaaatgtttctctgtcacctaggattatagaacactgctgctgggttctgagtgtttctccctcactttggattccagaacagagcttcgggggtctgaatatcagtccctcacataggactccaaaacactcctgctgtggtcggaaagtttgtccctcacattggattccagaacgctgatgctgtggtctgaatgtttgcccctcatataggattccagaatactcctgatgtaatctgaatgtttgtacctcacataggattcctgaacactcctgctgtggtccgaatgtttgtccctcacatggcattccagagcactgctgctggggtctgaatgtttgtccttgacataggatttcacaacactgctaagtgggtctgaatgtttgtcccttacttaggataccagaaaactcctgctgtactgtgaatgtttattcctcaaatacaattccagaacactgcttctgtagtatgaaaggctgtccctcacagaggattccagagcactggtaggaaattctgaatgtgagtccctaacataggattccagaacactgctgctgggttctgagggtttgtacctgccttaggatttcaggacactgttacgagggtctgattgtttctccctcacataggattccagaacactgctgctgggtctgaatgtttgtccctcacataggattccagaacactgctaagagtgtctcaatgtttgtccctcacataggattccaaaacactgctacgaggttctgaatgtgagtccctcacataagattccagaacactgctgctgtggtctgattgtttgtccctcacataggattccagaacactgccgctgtggtctgaatgtttgtccctcacataggattccagaacactcctgctgtggtctgaatgtttgtccctcacttaggattccagaacagtactgtggggttctgagtgtttgtccctcacgtatgattccagaacactgctacttgggtctaaatatttgtccctcacataggattccagaacactgctgctggggtctgaatgtttgtcccttacataggagtccagaacactcctgttgtagtctgaatgtttgtccctcacataagattccagaacactgctgctggattccgagtgtttgtctctcacataggattccagaacactcctacgggggtctgaatgtttgtccctcacataggattccagaacattgctaagagggtccgcattattgtccctcacataagattccagaacaatgctaacagggtctgaatgtttgtccctcacataagattccagaaccctgctgcagtggtctgaatggctgatcctcacataggattccaaaacactcctgctgtggtctgggtgtttgttcctcaggtgagattccagaacaatcttgctgtggtctgaatgtgtctccctcacataggattccaaaacattcctgctgtgatctgagtgattgttcctcaaataggattccagaacactgctactcgggtctgaaagtttgtccctcacataggattccagaacactgctaccagggtctgaattattctccttcacataggattccagaacactcctgctgtgatctgaaagtgtgtccctcccctaggataccagaacactgctgttgtgttctgagtgtttttccctcatgtaagattccacaacactgctgttgtgttctgagtgtttttccttcatgtaagattccagaacactgctacgtgggtctaaatgattgtgcttcaaatacgattccagaacacttcttctggggtctgaaagtttgtccctcacatcggattccagaacactcctgcagtggtctgaaagtttgtccctcacatagtattccagaacaatgatgctgtgttctgaatgtgtgtccctcacataggattccagaacactccttctgtgatctgaatgtttttccctgacaaaggattccagaacactgctgctgggttctgattgtttgttcttcacttaggattccagaacactgatatgagggtctgatgtttgtccctcatataggattccagaacactgctgctgggttctgactgtttctccttcacataggattccagaacactgccttgacggtctgaatgattatacctcacataggattccagaacactcctgccccggtctgaatgtttgtccctcatatgggattccacaacactgctgctgggttttgagtgtttttccctcacataggattccaggacacttctaagagggtcttaatgtttttccctcacataagattccagaacactgctacgagagtctgaaagtttgtccctcacataggatttctgaacactgctatgaatggtctgaatgtttgtcccacacaaaggagtccagaacactccagcggtgttctgaatgtattttcctcacataggattccagaacaatgctatgagggtttgcatgcttgccccacacgtaggattccagaacatcccagctgtggtctgaatgattgtcctcacataggattccagaacactcctgctgtggtgtgggggtttgcgccacacatggaattccagaacaatcctgctgtggtttgaatgtttttccctcacataggactccagaacactcctgctgtggtctgagttttctccctcaaataggattccagagcactgctaaggcggtctgaatgtttgtccctcacgtaacattccagagcactgctacgaggttctgaatgtttatcccttccataggattccagaaccctactgctgtggtctgagtggttgaccctcacatatgattccagaacactactgctgtggtctgggtgtttgtgcttcgcatgggattccagaacaatcctgctgtggtctgaatgtttctcactcacataggattccaaaacattcctgatgtggtctgagtgtttgtccctcaaataggactccataacactaccattggggtatgaatgtttgttcctcacataggattccagaacactgttacgagggtctgaattattctccctcacatagctttccagaatacgcctgctgtggtctgaatgtttgtccctcaattaggattccagaacactgccgttgggttctgagtgtccgtgcctcacgtatgattccaaaacactgctacgtgggtctaaatgtttgtcccacacataggactctagaacaccgctatgagggtctgaatatttatccctcacataggacttcaaaacactcctgccgtgctctcaatgtattttcctcacataggactccagaacaatgcgacgagggtctggatgcttgtcctacccttaggattccagaacaccccagctgtggtctgcatgtttgtccctcagataggattccagaacactgctgcttgatttgtttgtccctcagagatgattccagaacactgctatgagggtctgaatgtttgttcctcacatgagattcgagaacactcctgctgtggtctgaatgtttgtcccaaacctaagattccagaacactgttgctgggttctgagtgtttgtctctcacataggattccagaacaaatgtacaagggtctgaattattttccctcacataggattccagaacactcctgctcttgtctgaatatttgtccttcacaaaggattccagaacactactgctgtgatctgaatggttgaccctcacacaggattccagaacatttctgctgtggtctgggtgtttgtgcctcacatgggattccagaacaatcctcctgtggtcttaatgtttctacttcacataagattccaaaacatttatgctgtggtctgagtgtttgtccctcaaaaaggattccagaatcctgttaggagggtctgaattattctctctgataggattccagaacacggctacgagagtctgaatgtttgtccctcacaaagtactccagaagactcctgatgtgttctgaatgtattttcctgacataggattccagaacaatgctacgagtttctgaatgcttgtcccacacataggattccagaacacccccgctgtggtctgaatgattgtccctctcataggattccagaacactgctgctgtgttttgagattttctccctcacataggattccaaaagactgctacgaggttctgaattattctccatcacatgggattccagaacacccctgctgtcttctgaatgtttctccctcacatagtgttccataacactactgctgggttctgagagtttttccctcacataggattccagaacactgctacgagggtcagaatgtttgtccaacccatttaattccagaacaatcccgctcttgtctgaatgtttgtccctcacataagattccagaactctgcagctgggttctgattctttgtctctcacgtaggattccagaacacttctacgagggtctgaatgtctgtccctcacataagattccagaacactgctgctgggatatgagtgtttgtccctcacataggattacagaacacggctacgagggtctgtatttttctccttgacataggattccagaacactcctgctgtggtctggatgtttctccctcacttaggattccaatacaatactgctgtggtctgaatggttgtctctcacataggattccagaacaatcatgctgtcatctgagtgtttgtccctcaaataggattccagaacactgctatgaaggtctgtattattctccctcacataggattccaaaacaatgctagaagggcctgaatgtttttcccacacttaggattccggaacaccccagctgtggtctgaatgactgtccctaacataggattcctgaaaactgctgctgggttctgagtgtttttccctcacataggattccaaaacactgctacgagggtctgaatgtttgtcccttacaaaggattccagaacactactgctgtggtctgaatatttgatcctcacataggattccaaaacacagctgctgggttattagtgtttccccctcgcataggattccagaacactgctaagagggtctgaatgtttgtccctcacataagattcctgagcactgctacgagggtctgaatgtttctgcttcacatagcatttccagaacaccaatgctgtggtctgaatggttgaacctcacataggattccagaacactcctgctgtggtatggatgtttgtgtctcacatgggattccagaacagtcatgctgtcatctgagtgtttgtccctcaaataggattccagagccctgctacgacggtctgtattattctccctcacataggattccagaacacggctacgagggtctgaagatttgtcccacacataggactccagaacactcctgctgtgttctgaatgcattttactaacataggattccagaacaatgctacgagggtctgaatgcttgtcccacacgtaggattccggaacaccccagctgtggtctgaatgactgtccctaacataggattcctgaacactgctgctgggttctgagtgtttttccctcacataggattccaaaacactgctacgagggtctgaatgtttgttcctcacaaaggattccagaacactactgctgtggtctatttgaccctcacataggaatccaaaacactgctgctgggttctgagtgtttctccctcgcataggattccagaacactgctacgaaagtctgaatgtttgtccctcacataagattccagaacactactgctgtggtctgaatggttgacccacccaaaggattccagaacactcctgctgtggtctgtgggtttttgcctcacatgggattccagaagaatcctgctgtgatctgagtgtttctccttcaaataggattcctgaacactgctacgagggtctgaattattctccctcacataggattccagaacactcctgttatggtctgaatgtttgtccctcacttaagattccagaacactgatgttgggttctgactgtttgtccctcaagtacgattccagaaccctgctacgtgggtctaaatgtatgtccctcacataggattcctgaagactcctacaagggtctgaatgtttctcccgcacataggactccagaacactgctatgagggtctgaatgcttgtcccacacgtaggattaaagaacaactcagctgtggtctgaatgattgtccctaacatgggattccagaatactactcctgggttctgagtgtttgtccctcacataggattccagaacactgctatgagggtctgaaaattgtccctcacataggattccagaacactgctacgagcatctgatttattgtccctcacataggattccagaacactcctgctgtggtctgaatatttgtccctcacataggattccagaacactgctacgagggtctgtatgtttgtcccgcacgtaggtctccaggacactactgctgtattctgaatgttcttcctcaaataggatttcagaacaatgctatgagggtctgaatgtttgtcccacacgtagggatccagaaaaatcccagctgtggtctggatgactgtccctcacataggattccagaacactgctgctggattctgagtgtttctccctcacataggattccagaacactgctgttggattctgagagtttttcccttacataagattccagaaaacagttatatgggtctatatgtttatccctcacagaggattccagagcactgctacgaaggtctgaatgtttgtccctcacataggattccagagcactgctacaggggtctgaattattctcttcacataggattccagaacactcctgctgttgtctgaatgtttgtccctcacttaggattccagaacactgctgttgggatttgagtgtttgtccctcaagtatgattccagaaccctgctacgtgggtctaaatgtttgtccctcacataggattccagaacactgctacgagggtcctaatgtttgtcctgcacataggattccagaacactcctgctgtgttctgattgtgttttcctcacataggattccagaacaatgctacgagtgtctgaatctttgtcccaaacttggattccagaacccaccagctgtggtctttctgatggtctcacataggattccagaacactgatgctgggttctgagtgtttctccctcacataggaatccagaaccatcctgctgttgtctgaatgtgtgtccctcacttaggtttccagaatactgctgttgggttctgagtgtttgtccctcacgtacgattccagaacactgctacgtgggcctaaatgtttgtccctcacatagggttccagaacactgctatgagggtctgaatatttgtcccacacttaggtttccagaacaccccagctatggtctgaatgattggccctcacataggattctggtacactgcttctgggttctgagagattctctctcacataggatttcaggtcactgctgctggggtctgaatgtttgtccctcacataggattccagaaaactgctacgaggttctgaattattctccctcacataggattccagaacactcctcctgtggtctgaatgtttgtcccttacttaggattccagaacagtgctgttgggttctgagtgtttgtccctcacgtactattccagaacactggtaagtgggtctaaatgtttgtccctcacttaggattccagaacactgctgttgggttctgagtgtttgtccctcacatactattccagaacactggtacgtgggtctaaatgtttgtccctctcataggattccagaacactactacgagtgtctgaatgtttgttcctcacataggattccagaacactcctgctgtggtctcaatgtttgtccctcacttaggattccagaacactcttgctgtggtctgaatgtttgtccctcactgaggattccagaacactgctgttgggttctgagtatttgtccctcacgtagggatccagaacagtgctacatgggtctaagtgtttctcccagatatgggattccagaacactgctacgagagtttaaatgtttgtccctcacataggattccagaacactgctacgagggactgaatgattgtacctcacataggataccagaacactcctgctctcgtctgaatgtttgtccttctaataggattccagaacactgctgctactttctgagtgtttatccctcacataggatgccagaacactgctgctggggtctgagattttgtctctcacataacattccagaactctgctgctgggttctgagtgtttgtccctatcatacgattccagaacactgttgcgaggttctgaatgtttgtccctcacataggattccaggacactactgctgtggtctgaatggttgaccctcacataggattccagaacactcctgctgtggtctgggtgtttgtgcctcacatgggattccagaataatcctgctgtggtctgaatatttctccctcacataggattccaaaacattcctgctgtggtctgagtgtttgttcctcacttaggtttcgagaactctcctgctgtggtctgaatgtttgtcccttacataggaatccagatcactgcttctgggttctgagtgtttgtccttcacataggattccagaacactgctacgagagtctcaatgtttgtccctcacgtaagattccagaacactgctacgaggatctgaatgtttgtctcacacgtaggattccagaacaccctagctgtggtctgaatgattgccccacacaaagcattctacaacagtgtcactgggttctgagtgttgtccctcaaatagaattcagaacactgctacgagggtctgaatgtttgcccctctaataggattccagaacactgctacgaggatctgaattattgtcccttatgtaggattccataacactgcttttgggttctgagtgtttttccctcatgtttgattccagaacagtgttacatgggtctaaatgtttgtccctcacataggactccagaacactgctacgagggtctgaatgttggtccctcacataggattccagaacactgctacaagcgtctaaattattctccctcacataggataccagaactcacatgctggagtctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggactccagaacactgctacgagggtctgaatgttggtccctcacataggattccagaacactgctacaagcgtctaaattattctccctcacataggataccagaacacacatgctggaatctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggactccagaacactgctacgagggtctgaatgttggtccctcacataggattccagaacactgctacaagcgtctaaattattctccctcacataggataccagaacacacatgctggaatctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggattccagaacactgctacaagggtctgaatgtttgtcccgtacataggactccagaacacacctgctgtgttctgaatgtgtttccctaacctaggattccggaacaatgctacgaagttctgaatgctagtcccacacgtagaattccagagcaccctagctgtgctctgaatgattttctctcacataggattccagaaccctgctgctgggttctgatggcttctccctcacataggattccagaaaactgctgcgaatgtctgaatgattgtaaatcacaaaggattccgtaacactaatgctctcttctgaatattggtacctcagattggattccagaacacagcagctgggttctgagtgtttgtccctcagaaaggattctagaacactcctacgagggtctgaaagtttgtccctcacataggattccagagcactactgctatcaactgaaaatttgaccctcacataggattccagaacactcctgctgttgtctgtgcctcacttggtattccagaacaatcctgctgcagtctgaacgtttctccatcacataggattccaaaacattgcttctgttgtctgagtgtttgtcccaaaatagaattccaggacactgctgctgggttgtgactgtttgtccctcacaaagcattccataacactgctgccgtcgtctgaatgtttgtccctcagatacaattccaaaacattcctgctgtggtctcaatatctgttcctcccttaggattccagaacaaagctctgaggttctcagtgtttgtctcacacttatgattccagaacgctgctgtgtgggtctaaatgtttgtctctcacataggattccagagcactgctcctgggtactgaatgtttgtccatcacataggattccagaacactcctgttgtggtctgaatgtttgtccctcacgtaggattccagaacactgccgctgggttgtgagtgtttgttcctgacgtacgattccagaacactgctacgtcggtctaaatgtctgtccctcacataggattccagaacactgctccttgggactgaatgtttctccctcacataggtttctagaacactcctgctgtggtctgaatgtttgtccctcacataagattctagaacactgctgctttgttctaaaactttgcccctcacataagattctagaacactgctgctttgttctaaaactttgcccctcacataggattccagaacacttctaagaggatctgaatgtttgtccctcacataagactccagaacactgctattgtggtctgaatgtttgttcctcacataggattccggaacactgctgctgggttcttagtgtttttccttcatataggattccagaacacagctacgagggtctgaatatttgtcctgcacataggactccagaacactccttctgtgttctgaatgtattttcctaacagaggattccagaacaatggtacgaggttctgaatgcttgttctacacgtaggattccagaacaccccagctttggtctgaatgattgtccctcacattggattccagaacactgctgggttcgcagtgtttgtctctcacataggattcgagaacagtgctacgagggtctgaatgtttttccctctcataggattcaagaacactgcagcaaccgtctgaattattctcccacacatgggattccagggcactcttgctgtggtctgaactgtgtgtccctgaattaggattccagaacactcctgctttaatctgaatgtttgtccctcacataggattccaaaacactcctgatttgatctgaatgtttgtccctcacataagattcaagaacactgctgctggggtctggaagtttgtccctcacatatgatttcagaacacttctacgggtttctcaatctttgtccctcacataggattccagaaatctgcttctggcttctgagtgtttttctctcacataggattccagaacactgctatgagggtctgaatgtttgtccctcacataggattcctggacactcctgctgtggtctgaatgtttgtcccacacacagaactccagaacaatgctgctgggtgtgaatgtttgtcactcacacaggattccagaacacccctgctgtgttctgaatgtttgttcatcacatagacttccagaacactcctgctgtggtctgggtgtttatctctcacataggattccagaacagtgctgctgtggtctgaatgtttgtccctcgcataggattccagaacactgctacgaagatttgaatgtttgtctttcacataggattttagaacactgcagcagggttctgaatatttgtccttcacataggattccagatcactactgctgtggtctgaatgtttgtcctttacataggatttcacaacactgctacgagggtctgaatgtttgtcccttaaataggataccagaaaactcctgctgtgctgtgaatgtttattcctcacataggattccagaacactgctgctttggtctgaaaggttgtccctcacagaggattccaaaactctggtacgaggttctgaatgtgagttcctaacataggattccagaacactgctgctgggttctgagtgtttgtacctgcaataagattccagaacacttctgctggggtctgaatgtttctccctcatgtaggattccaaaacagtcctgctgtcttctgagtgtttgtccctcaaatggggttcgagaacactgctatgagggtctgaattattctccctcacataggattccagaacacggctatgagggtctgaatgtttgtccctcacatatgattcctgaatactcctgctgtggtctgaaagtttccctcaaataggattccagaacagtgctgctgggttctgagtgtttttgcctcacatatgattccagaacactgctacgagtgtcctaatgtttgttcctcacataggattacagaacactgctgctgggttctgtgtatttctcactcacataggattccagaacactgctacgagggtctgaatatttgttcctcacataatattccagaacactgccaagagagtctgaatgtttatccctcagataagattacagaacaatgctacgaggctcagaatgtttgctcttcacatcggattccagaacactactgcagtggtctgaatggttgatgctcacataggattccagaacactcctgctgtggtctgggtgtttgtgcctcacatgggattccataacaatcctgctgtggtgtgaatgcttctctgtcacataggattacaaagcattcttgctgtggtctgagtgtttgtccctcacatagggctccagaacattcctgctgtcgtgggaatgtttctccctcacttatgtttccagaacactcctgctgtggtctgaatgtttatccctcacttaggattccagaacactgctgttgggttctgagtgttttgtgcctcacatacgattctagaacacttctacattggtctaaatgctcgtccctcacatagggctccagaaaactactatgagggtctgaatatttgtccctcacctaagactccataacactgctaagagagtctgaatgtttgtcccgcatgtagaattccagaacactcctgctgtgttctgaatgtattttcctcacttaggattccagaacaatgctacgagggtctgaatggttgtcccacacttaggattccagaacaccccagctgtggtctgaataattgtccctcacataggattccagaacactgctgctgggttctgagtgtttgtccctcacataggattccagaacactgttacgatggtctgaatgtttgtccctcaaataggattccagaacactgctatgagggtataaattattctccctcacataggattccagaacactcctgctgttgtctgaatatttgttccccactaagtattcaagagcactcctgctgcagtctgagtgtttgtccctcacttaggattccagaacactactgttgggttctgagtgtttgtccctcaggtacaattccacaacactgccacgtgggtctatatgtttgtctgttacgtaggattccagaacagtgctacgagggtctgaatgtttttctcgcacataggactccagaacactcttgctgtgttctgaatgtattttcctatgataggattccagaagaatgttatgagtgtctgaatgcttgtcgcacatgtaggattccagaaaaccccagctgtggtctgaatgattgtccctcacataggattccagaacactgctgctgggttttcagagtttgtccctaccatagcattccagaacactgcgacgagggtctaaatatttgtcattcacatagaattccagaacactgctactgggttctgagtgtttgtccctcacaaaggattcctgaacaatgctgctgtggtctgaatgtttgtctctcatataggattccagaacactactgctgtggtctcaacgtttgaccctcagatatgattccagaatactcctgctgtgatcagggtgtttgtgtctcacatgggattccagaacaatccttctgtggtctgaatgtttctccctcacataggattccaaaacattcctgctgcagtctgagtgtttgtccctcaaacaggattgtagaacactgctactggggtctgaatgtttgtccctcacataggattccaaaaccctgacaggagggtctgaattattctccctctgataggattccagggcactcctgttgtggtctgaatgtttgtccctcacttaggattccagaacactgctgttaggttctgagtgtttgtccctcatgtgcgattccagaacaatgttacgtgggtctaaatatttgtccctcacataggattccagaacactgctaggagggtctgaatgtttctctcgcacgtaggactccagaacactcctcctgtttcctgaatgtattttcctcacatgggattccagaacaatgctaccagggtctgaatgtttttcccacacttaggattccagaacacctcagctgtgttctgaatgattgtccctcccataggattccagaacactgctgctgggttctgagtgtttctccctcacatacgattccagaacactgctacgagggtctgaatgattgtagttcacataggattccagaacactcctgctctgttctgaatgtttgtcactcagataggattccagaaaaaaggtgctgggttctgaatgtttgtccctcacataggatttcagaacactcttgctgtggtctgaatgtttgtccctcacataggattgcagaacactactgctgtggtctgaatggttgaccctcacataggattccagaacatccctgctctggtctgggtgtttcccccttaaataggattccagaacactgctgctgggttctgagagtttgtccaacacacaggatcccagaactctcttgctgtgttctgaatatttgtcactcatataggattccagaaccctgatgctgtggtctgaatggttgaccctcacataggattccagaacaatcctgctgtggtctgtgtgtttttaccgcacatggtattccagaacaatcctgctgtagtctgaatgtttctccctcgcataggcttccaaaacattcctcctgtgtctgagtgtttgtccctcaaataggattccagaacactggtattgacatcttaatgtttgtccctcacttaggattccagaacactgctgttgggttctgagtgtttatcctcacgtacgatgccggaacactgttacgtgggtcttaatgttagccctccacagaggactccagaacacggctacaagggtatgaatgtttgcctcacacataggactgaagaacaatcctgctgtgttctgaatgtattttcctcacataggattccagaacaatgctacgagggtctgaatgtttgtcccacaaataggattccagaacacaccagctgtgggctgaatgattgtccctcacatgggattccagaacaatgctactgggttctaaatgtttgtccctcatgtaggattcctgaacactactgctggggtctgaatatttgtccctcatctaggattccagaagactactgctgtggtctgaatgtttgaccctcacataggattccagaacacgcctgctgtggtctgggtgtttgtgcctcacatgggattccagaacagtcctgctgtggtctgaatgtttctccctcacatatgattccaaaacatttctgctgttgtctgagtgtttgtccctcaaataggattctagaacactgctactggggtatgaatgtttgttcctctcataggattccagaacactgctacgagggtctgaattattctaccccacataggattccaggacactcctgctgtggtcagaatgtttgtccctcacttagtattcctgaacactgctgttgggttctcagtgtttggccctcacatactattccagaacaccacagctgtggtctgaatgtttgttcctcagatgggattccagatcactcctgctgttgtctgaatgtttttccctcttataggcttgcagaacactactgctgttgtctgaatggttgaccgtcacataggattccagaacacccctgctcttgtctgggtgtttgtccctaaaataggattccagaacactgctgctgcgttctgagtgtctgtcccttcacataggattccagaacagtgctgatatggtttgaatatttgttcctccatagaattctagaacaatcctgctgtaatctgaatgtttgtctctcatacaggattccagactactactgctgtggtctgaatgtctgaccatcacataggattccagaacaatcctgctgtggtctgggtgtttgtgcctcacatgggattgcagaacaatcctgcagtagtctgaatgtttctccctcacattggattccaaaacattcctgctatggtctgagtgtttgtccctcaaatacgattccagaacactggtattgaggtctgaatatttgtccatcacataggaatccagaacactatcacgagggtttgaattattctccctcacataggataccagcgcactcctgctgtggtctgaatgtttgtccctcattaggattccagaacactgctgttgggttctgagtgtttgtccctcacgaaagattccagaacactcccatgtgggtctaaatgtttttccctcacataggattccagaataccgctaagagggtctgaatgtttgtcccgcacataggactccagaacactcctgatgtgttctcaatgtattttcctcacataggattccagaacaatgctaccggggtctgaatgtttttcccacatataggattccagaacaccccagctgtggtctgaatgattgtaccttacataggactcccgaacactgctgctgggttctgagtgtttctccatcacataggattccagaacactgctgctggattctgagtggttctccatcacataggattccagaacactgctacaagggtctgaaccattgtatctcacataggattccagaacactcctgctgtggtctgaatgtttgtacctcatctaggattcccgagcactgctgctgtggtctgaatggttgaccatcacataggatggcagaacactcctgctgtggtctgggtgtttgtgcctccaatgggattccagaacaatcctgctgtggtctgaatgtttctccctcacatagggttccaaagcatccctgctgtgctctgagtgtttgtccctcaaataggattccagaacactgctactgtggtctgaatgtttgttcctcacataggattgcagaacactgctacgaggctctgaattattctcccttacataggattccagaacactcctgctgtggtctgaatgtttgtccctcacttagaattccgcaacgctgatgttgggttctgagggtttgtccctcacgtacgactccagaacactgctacgtgggtctaaaggtttctccctcacataggattccagaacactgctacaagcctctgaatggttgtcccgcacataggactccagaagattcctgatgtgttctgaatgtgttttcctcacatgcgattccagatcaattctaattgtgtctgaatgtttgttccacacgtaggattacagaacaccccagctgtggtctgaatgattgtccctcacataggattccagaacactgctgctggtttttgagtgtttctccctcacgtaggattccagtacactgctacgagtgtctcaatgattgtacttcacagaggattaaagaacactcctgctctggtctgaatgtttgtccctcagataggattccagaacactgctgcaaggttctgagtgtttgtccctcacatgagattccagaacactgatgctgtggtctcaatgtttgctcctcaccgaagtttccagaataagcctgctgttgtcttaatgtttgttcctcaaataggattacagaacactactgctgtggtctgaaaagttgaccgtcatataggattccagaacactagtgctgtggtctggctgtttgtgcctcacgttggattctagaacaatccttctgtgttctgaatgtttcttcctcacataggcttccaaaatattcctgctgtggtctgagtgtttgtccctcaaataggattccaaaacactgctacttgggtctaaaggattgtccctaacataggattctggaacactcctacgagggtctgtatgtttcttccgcacataggactccagaacactcctgctgtattgtgaatgaattttcctcaaataggattgcagaacaatgctgcgagggtctaaatgtttgtctcacaggtaggattccagaacaccccagctgtggtctgaatgattgtccctcacataggattccataacactgctgctgggttctgagtgtttctccctcacataggaaaccaggacactgctactgggttctgaatgattgtacctcacattggactccagaacactcctactgtggtatgaatgtttgtctctcagacaggattacagaacactgttgctgggttctgaatgtttgtcactcacataagattccagaacactgctcttgtgttctgaatgtttgttcctcacataggatttcagaacactcctgctgtggtctgaatggttgaacctcatataggattccagaacactccttctgtggtctgggtgtttgtgccttacatgggattccagaacaattctgctgttgtctgaatgtttctctctcacataggattccaaaacattcctgctgtggactgagtctttgtccctcaaataagattccagagacctggtactggggtctgaatgtttgtccctcacataggattccataacactgctatgaggttctgaattattctcccacacataaggttgcagaacactcctgctgtggtctgaatgtttgtccctatcttattattccagaacactgatgttgggttctgagtgtttgtccctcacgtacgattccagaacactactaagtgggtctaaatgtttgtccctcacatagaattccagaacactgttacgagggtgtgaatgtttgcctcacatagcattccagaacaatgctacaagggtctgaaagtttgtcccacatgcaggattccagaacaccacaggtgtggtctgaatgattgtccctcaaataggattacagaagactgccgctgggttctgagggtttctccctcacacaggattccagaataccgctacgagggtctgaatgattgtccctcacataagattccagaaccctcctgctgtggtctgaatggttataccttacatccgattccagaacactgctgctgggttctgagtgtttgtccctcacataggattccagaacacttctatgagggtctgaatgtttgtccctcacataggattcaagaacacccaatctatggtctgaatgattgtccctcacataggattccatatcactactgctgggttctgagtgtttctctctcacataggattccagaacattactacgaggttctgaatgattgtacctctcataggattccagaatactcctgctttggtctgaatttccgtccctcagatagaatgccagaacactgctgctgggttcttagtgtttgtcccttacataggattccagaacactgctacgagggtatgaatgtttgtccctcacatagaattctagaacactactgctgtggtctgaatggttgaccttcacatagcattctagaacactcctgctgttgtctgagcgtttgtgcctcacatgggattccagaaaaatcctgtggtcatctgaatgtttctccctaacataggattccaaaacatccctgtagtgttctgagtgtttgtccctcaaataggattccagaatgctgctactgggttctaaatgtttgtccctcacataggattccagagcaatgctatgaccatctgaattattctccctcacataggattccagaacactactgctgtggtctgaatgtttgaccctcatatagggttccagaacactcttgtgttctccgtgtttgtgccttacattggtttctggaacaatcctgctgtggtctgaatgtttctccctaacatgggattctaaaatattcctgctgtggtctgagggtttgtccctcaaataggattccagaaaactgtaacttgagtctgaatgtttctccctcacataggattccagatcactgctacgagggtctgcattattctccctcacaaaggattccaggagactcctgctgtggtctgaatgtttgttcctcactaagaattccagaacactgctgttgggttctcagtgtttgtccctcacgtacgattacagaacactgctacatgagtctaaaagtttttccctcaataggatttcggaacactgctgctggcgtctgaatgtttgtacctcacatgggattccagaacaatcgtgctgtggtctgaacgttactcacataggattccagaacattccttctgtggtctgaatgtttctccctcacgtcggattccagaacactgctacgagagtctgaatacttttccctcacataggatttcagaacactgctaagagggtctgaatgtttgtccttcacataagatccaagaacactgcctctgggttttgatcgtttgtccttcacatcgaattctaaaacactgccacaggagtctgaaagtttgtccctcacataggattcaagaacactgctaagaggttctgaagctttgtccctcacataggattctggaaaaattttgctgtggtctgaatgtttgttctgcacaaaggattccagaaaacttctgctgtggtctgtatatttgtccctcacataggattccagaacacccctgctgggttctggctgtccctcacataagacgcaataacccttctgctgtgatctgtatgtttgtccctcacataggattccacaacactgctaggagggtctgaatgtttgtccttcacataggattccagaacactgctgctggggactaaatgttattccttcaaaaaggattccagaacacttctgctggggtctggatgttttctccctcacataggattgcttaaaaatgcttctaggctctaaatgtttgtccatcacagaggattccagaaccgttctgctggtttctgactgtttctcccacatataggtatccagaacactgctgcaggggtctgaatgtttatccatcatataggattaaagaacactcctgcttaggtctgaatgtttgcccctcatataggattccagaacaatgcttctggcatctgaatgtttgtcgctcgcataggattccacaacactgctgctggtttctgagtgtttggccttcacataggattccagaacactgctaccagggtctgaatgtctgtctctcacataggattccagaacattcctcctgtggtatgaatgtttgtccctctcataggattccagaacactgctgctgggttctgagtggttagccctcacaaaggattccagaacactgctaagagggactgaatgtttgtccctcaaatagcattccagaacactcctgatgtggtctaaatatgcgttcctcacataggattccagaagaattctgctctagtctgaatctttgtccctcactagtattccagaacactgcttcaagggtctgaatgtttgtccctcacaggggattctagtacactcctgttgtggtctgactgtttgtcccccacataggattccagaacactgctaggaggaactaaatgcttacccctcacataggtttccggaacactcttaccagggtctgaatgtttgtccctcacaggggattccagaacactcctgttgtgatatgagtgtttctccctcacatatgattccagaacactcctgctgttgtctgaatgcttttccctcacacaggttcccagaacactcctgttgggttgtgagtgtttgtccctctcctaagattccagaaaactgctacgaggttctgaatatttgcccctcacataggactccaggacactgctgctgtgttgtaaatgtttgtttctcacataggatttcagaagactcctgctgttgtcttaaagtttgtcccacacataggattccaaaacagtcccgctgttgtttgaatgtttgtcccttacataggattccaaaacaatgctgctggcgtctgaatgtttgtccctcacgtaggattcaagaacaccgttacgaatgtctgaatgtttgttcctcacataggatttcagaacaatacagctgtgatctgactgtttgtccctcaaatagggttccagaacactgctgctgggttctgagtgtttgtccctcacatcggattcctgaacaccgctgcgagtgtctgaatgattgctcctcacataggattctagaacagtgctgctgaggtctaaatgtttgtccgacacatatgattccagaacactgctaagagggtctgaaggtttgttcctcacacagaattccagaacactgctacgagcatctgaaagtttgtccctcacacaggattccagaacactgctacgagggtctgaaagtttgtccctcacacagagttccagaacactgctacgagcatctgaaagtttgtccctcacacagaattccagaacactgctacaagcatctgaatgattgtccctcatataggattccagaacgctgctgctggggtgtgaatgtttgtccctcacataggattccagaacaatgctgctggagtctatatgtatgtccttcacatgattccagaaccttgctgctgggttctgagtatttctccctcacatagaattccagaacactgcgacgagggtctgaatgtttgttcataacataggattccagaacactttcgctgttgttttaaagtttgtccctcacataggattccagaacactgctgctgaggtctgaatgtttgtccctcgcataggattccagaacactgctgagactgtctgaatgtttgtccctcacatattattccagaacattgctacgattgtctaaatgtttgtccctaacatagcattccagaacaatgctccgagggtctgaatgtttgtccctcacatacgattctggaacactgatacgattgtctgaatgtttctccctcacatatgattctggaacactgctacgagggtctcaaaatttgtccctcacataggattccaaaacactcctgctgtgttctgagtgtttgtccctaacataggattccagaagaatcctgcagtggtctcaatgtttgtccctcacatagggttccagaacactgctgctgggttctgagtgtttgtacctcacataggattccagaacactgctgctatggtctaaatgtttgtccatcacgtaggattccagaacattgctacaagggtctgaatgtttcttcctcacagggcattccgtaacactcctgctgtggtctgaatgtttgtccctcagacaggattccagaacactactacgaggttcctaatgtatgtccatcacacagaattccagaacactgctctgagggtctgaatgattgtccctctcatgttattccagtacactactgatggggtctgaatgtttgtccctcacataggattccagaacactgctacggggctctgaatatttgtcactcacatagaattccagaacccttctacgattgtctgaatgtttgtccctcacataggattccagaacaccgctacgaatgtctgaaggtttgtccctcacttaggattccagaagaatacagctgtggtcggaatgtttgtatctcacatagggttccagaacactgttgctgggttctgagtatttgtacttcacataggattccagaacactgctacgagtgtttgaatgactgtccctcacataggattccagaacacttctacgattgtctgaatgttggtctctcacacagggttccagaagactgcagctgggttctgagtgtttgtccctcacttagaattccagaacactgcaatgatggtttgaatatacgttcctaacataggattccagaacactcccgctcttgtttgaatgtttgtccctcacataggattccagaacactgctacggttttctgaatgtttgtccctcacataggattccagaacacttctacgattgtctgaatgttggtccctcgcataggattccagaacattgttatgagggtctgaatgtttgttcctcacaggggattccaaaacactcctgctgtgttctgagtgtttgtccctcacataggattccagatcactgcaacgagggtctgaatgaatgtgcctcatataggattctagaacgctgctgctgaggtccgaatgtttctctctgacatagggtttcagaaaactgctacaagtgtctgaatgtttgtccctaatataggattccataacactccggctgtggtctgaatgtctgtccctcacacaagattccagaactctgctgctgtagtatgaatggatctccatcacatagcattccagaacactgctacgagggtctgaatgtttgtgcctcaaataggattccagaacactgctgctggggtccgaatgtttgtgctcacataggattccaaagcactgctatgagattctgaatgtttttccatcacataatattccagaaaactgctacgagcgtctggaagtttgtgcctcacataggaccaaagaactctgctgctagaatgcgaatgtttgttgctaacatacaattccagaacactcctgctgtgtctgaatgtttgtctttcacaaaagattccagaacactcctaccggggtcttaatttttgtccctcacataggattcaacaacactgttgctggggtctcaaagtttgtccctcaggtaggattccagaacactgctgctggggtctaaaagtttgtctgtcacataggatgccagaaaactgctgttagtttctgagtgtttctccgtcacatagaattccataacaatgcaatgaggatctgaatgtttgtccataacataggatttcagaacactccagttattgtttcaatgtttgtccctcgcataggattccagaacactgctaagagggtctgaatgtttgttcctcacataggattccaaaacactcctgctgtgttctgagtgtttgtccttcacataggattccagatcaatcatgcagtggtctgaatgggtgtccctcacataggtttccagaacactgcaacaggggtctgaatgtttttccctcacattgcattccagaaaactgctacgattctctgaatgtttgtctcccacataggattccagaacactgctacgagggtctgattgtttttttctcacattggaccccagaactctgttgctggggtctatatgtttctctgtcaaataggattccagaaccctgatacgagggtctgaatgtttgttcctcacaggggattccagaacactccttctttggtttaaagctttgtccctcacacggaattacagaacagtggtacgagggtctgaatgattgtccttcccataggattccagaacactgctatgatagtcttaatatttgtccctcacataggattccagaacactgctacgatagtctgaatgtttgtccctaacataggattccagaacactgctatgaggatctgaatatttgtctctcacataggattccaaaacactcttgctgtgttctgagggtttgtctctcacataggattccagaacaccgctacgacagtctgaatgtttgtccctcacattggatttaagaacactgttatgaagttctgaatgtttgtccctcacataggattccagaacactgctacgattatgtgaatgtttgctcctcacataggattccagaacactgctacgagggtctgaatatttgtcctccaagttggattccaaaacactcctgctgttttctgaatgtgtgtccctcacatagaattccagaacaatcctgctgtggtctgaatgtttgtccctaacatagtgttccagaacactgcagctgggttctgagtgtttgtccctcacataggattccagaacactgctacgagtgtctgaatgtttctctctcacataggattccagaacactgctgctggggtttaaatgattgtccatcacataggattcctgaacactgctacgagtgtctcaatgtttgttcctcaccggggattccacaacacccctgctgtggtctgaaagtttgtccctcacattgaattccagaaaactgcaaggagggtctgaatgtttgtccctcacacagaattccagaacactactacgagggtctgattgactgtccctcacgtaggattccagaacactgcttctggggtcttaatgtttgtcccccacataggactccagaacactgctgcaggagtctatgtgtatgtctttcacatcggattccagaacactgaggccgggttctgagtgtttctccctcacatagattccagaacactgcatcgagggtctgaatgtatgtttctttttatgttatattatttcgtttattattattatacttggaatttatgtttctaacgtaggattccagaacacttccgctgttttttgaatgtttttccctcacataagattccagaacactgctgctggggactgaatatttgtcactcacattccagaacagttctacggttgtctgaatgtttctccctcacataggattccacaacactgctacaagggtctgaatgtttgtccctcagataggatttcagaacacttctacgattgtctgattgttggtccctcacatcggattccagaacactgcgacgagggtctgaatatttgttcctcacaggggattccaaaacactcctgctgtgttctgtttgtccctcacataggattccagatcactgcaacgagggtctgaatgaatgtgcctcatatagtattccacaacactgctgctggggtctgaatgtgtgtccctcacataggattccagaacactgctgctgcagtctactcgtgtgtccctcacattggatgccagaacactgctgctggttctgagtgtttctcccacacatagaattccagaacactgcaacgggggtctgaatgtatgatcctaacttaggattccagaccactcccgctcttgtttgagtgtttgtctgtcacatgggattccagaacacttctgctagggtctgaatgtttgtccataacataggactccagaacactcccgctgttgtttgaacgtttgtccctcatataggattctagaacactgcttctaggttctgaatgtttgtccctcacgtaggattccagaacactgctacaattgtctgaacctttgtccctcatataatattccagaacacttctgtgaggatcgaaatgtttgtcacatattattacagaacacccccactctggtctgaatgtttctcccgcacataggatgacagaatactgctgagagggtctgaatgattgtccctcaaataggattccagatcaatgctgctggggtctaaaggtttgtccgtcacatcggattccaggttactgctacagggttctgaatgtttattcctcacaggggattccagatcactacttctgtgttctgaaagtttgaccctcacgtaggattctggaacactgccatgattgtctgaaagtttttccctcacacagaattccagaacaatgcaacgagggactgaatgattgtctctcatgtaggatttcagaagactgctgctggggtctgaatgtttgtccctcacatacgagtccagaacactgctgctgaggtctgcatgtatgtccatcgcatagaataccagaacactgctgcggagttctgagtctttctccgtcacatagaattccggaaaactgcaatgatggtctgaatgtttgtccgtaacataagattcccgaacactcccgctgttgtttgtttgaatgtttgttcctcacataggattccagaacactgctgctgggttctgaatgtttgtccctcacataggattccagaacactgctacgattgtctgaatgtctgtccatcacataggattccagaacactgctgctggggtctaaatctttgtccgtcacattggattccagaacacagctatgagggtctgaatgtttctccctcacaggcgattccagaacactcctgctgtggtctgaatgtttgtccctcacataggtttccagagcactagtaggagtgtctgattttttgtcctcccataggattccaaaacactgctacgaggttctgaatgtttttccctcacataggatttcagaacactgctgcgagcatctgaatttttgtttctcacataggacaaaagaacactggtgctggggtctgaatgtttgttgctcccataggattccagaacactcctgctgtagtctgaatgtttctcattaacaaaagattccagaacactcctgctgggatctcaatatttgtccctcacacaggattcaaggacactgctgctctggtctgaaagtttgtccctcacataggattccagtacactgctacgagggtctgaatatttgtccctcacataggattccagaacactgctgcgattgtttgaatgtttgtctttcacgtaggatttcagaacactgatacaagagtctgaatgtttgtccctcacatcggattccagaacactcctatgattgtctgaatgtttgtcccttagataggattccagaacactgctacgagggtctgaatgtttttccctcatataggattccaaaacactcctgctgtgttctgagtgtttgtagacacatcagatccagaacactactgttgtgatctgaatgtttctgcatcacaccagattccagaacacgctacgaggttctgaatgacggtcccacacataggattccagaacaccgctgctggggtctaaatgtttgtccatcacacaggattcaagaacagtgctacgagggtctgaatgtttcttcctcactggggattccagaatagtcctgctgtggtctgaatgtttgtccctcacacagaattccagaacactgttacgagggtctgaatgattgtccttcatataggattccagaactctgctgctggtgcctgaatgtttttccctcacataggattccagaacgctgctgctggggtctacatgtatgtccgtcacataggaatccagaacactgctgctgggttctgtgtgtctctccctcacataaattccagaacactgcgacgagggtatgcatgtttgtccgaaacgtaggatgtcagacgctctcgctgttttttgaatgtttatccctcccataggattccagaacactctacgattgtctgaatgtctgaccctcacataggattccagaacactgctgggaggctctgaatttttgtccctcccataggattacagaacactgctacgattgtctgcatttttgtccctcacataggattccagaacactgctacgactgtctgcatttttgtccctcacatagtattccagaacactgctaggatgatctgaatatttgtccctcacataggattccagaacactgctaggatgatctgaatatttgtccctcacataggattgcagaacactgctatgagtgtatgaatgtttgcctctcacataggattccagaacacggctttgattatctaaatgttagtccctcacataggattcctgaacactcctgctgtggtctgatagtttttccctcacataggattccagaacactgctacgaggctctgaatgtttgtccctcacataggattccaaaacactcctgcagtgttcgaagtgtttgtcccccacataggatttcagaacaatcttgctgtggtctcaatgtttgtctctccataggattccagaatacagttgctgagttctgagggtttgtccctcacataggattccagaacactgctacgaggttctgaatgtttgtctctcacataggattccagaacactgctgctggggtctaaatgtttgtccatcacatcggaatccagaccacttttatgagggtctaaaagtttcttcctcacaggagattccagaacacttctgcagtgttctgaatgtttgtacctcacataggattccagaacactgctgctgccatctaaatgtttgtctgtcacataggattccagaacactgctatgaggtctcaatgtttgtccctcacgtagtattccagaacactgctacgagggtctgaatgtttgtacctcacagagcattccagaacactgctatgagtttctggatgtttatccctcacacagaattccacaatactgctacaagggtctgaatgattgtccctctcataggattccagaacactgctgctggggtctgaatgtttgtacctcacataggattccagaacactgctgctgggttctggatgtttgtccatcatataggattccaccacactgctgctggggtgtagatttatgggcgtcacctagattccagaacactgctgcaggtttctgagtgtttctccctcacatagaattctagaacactgcaactagggtctgaatgtttgtccttaacataggatttcagaacactcccgctgttggttgaatgtttctcccttacataggattccagaacactgctcctggggtctgaatgtttgtccctcacataggattctggaacactgctatgattatcttaatacatgtccctcacaaaggattccagaacattcctacgagggtctgaatgtatgtcccacacataggattccagaacactgctgctggggtctgaatgtttgtccctcacatagaataccagaaaactgctacgattgtctgaatgtttgttcctcactggggattccagaacactgctactgggtctaaatgtttatccatcacttaggattccagaacactgctacgagggtcggaatgtttgttcctcacggtggattccagaacactcctgctgtggtctgaatgtttgtccctcacacagggctccagaacacttctacaagggtctgaatgtttctcactcacacagaattccaaaacactgcaacgagggtctgaatgatcatccctcacataggagtccagaacaatgctgctggggtctacatgtctgaccgtcacataggattccagaacaatgctgctggggtctgcatgtctgtccgtcacataggattccagaacaatgctggtgggttctgaatgtttctccctcacatagaattccagaacactcggacgagggtctgaatatttgcctgtaacataggattccagaacactcccactgttgtatgaatgtttgtccctcacataggattccagaacgcagcagctgaggtctgaatgtttgtccctcacataggattccagaattctgctatgattgtctgaacgtttttccctcacataaaactccagaacactgctgctggggtctgaatgtttgtctgtcacataggattccagaacacttttactagtgtctgaatgtttgttcctcactggggattccagagcactcttcctgtggtctgaatggttgtccttcacataggattccagaacactgctacgacgttctgaatgcttgtccctcacacagaattccagaacactgttacgagggtacgaatgactgtgcctcgcatagaattccagaacactcctgctgaggtctaaatgtttgtccgtaacataggattacagaacaatcctgctgtggtctgaaattttgaccctcacacagggttccagaacactgctgctcatttctgagtgtttgtccctcacataggattcaagaacactgtgaagacggtgtgaatatttgtctgtaacataggattatggaacactcccgctgttgtttgaatgtttatcactcacataggattccagaacactgctgctggggtctgaatgtttgtccctcacataggattccagcacactgctatgattatctcaatgtttgtccctcacataggattccagaatactcctttgagggtctgaatgtttgtccctcacataggattccagaacactgctacaaaactctgaatgcttttccctcacataggattccagaacactgctaactagggtttgaatgtatgtccctcccataggattccagaacactcctgctgtggtctgaatgcttgtccctcacatacgattccagaacactactacgagggtctgaatttttgtcactcacataggattccaaaacattcctgttattttcttagtgtttgtccctcacatatcattccagaacaatcccgctgtggtctgaatgtttgtccctcacataggattccacaaaactgctacaagattctgaatggttttcctcactgaggattccagaacactgctcctggggtataaatatttggccgtcacataggattccagaacactactacgagggtctgtatgtttgttcctcacaggggattccagaacactaatgctgtggtctgaatgttcgttcctaacacaggattctggtacactgctatgagggtcagaatgtttgtccctcacattggattccagaacaatgctaccaatgtctgaatgtttgtccctcacatagaattccagatcactgctatgagggtctgaatgtttgtccctcacataggattccagaacactcctgctatggtctgtatatttgtccctcacatatgattccagaacactgctacgagagtctaaacgtttgtccctcacacaggatttcaaaacctttctgctgggttcggagtgttggtccctcacataggtttccagaacaatcctggcatggtctgaatgtttatccctcacatagggttccagaacactgctgctggtttcagtgtgtttgtcgctcatgtaggattccagaacactgctatgagggtctgaatgtttctacctcacataggattccagaacactgctgctggggtctaaatgtttgtctgtcacataggatgatttcacataggattacagaacactgctaagagggtctgaatgtttgttcctcacagatgattccagaacactcctgctgttgtctgaatgtttgttcctcacagatgattccagaacactcctgctgttgtctgaatgtttgtcaatcacataggattccagaacactgctatgaggctctgaatgtttgttcctcacacagaattccagaatactgctaccagggtctgaatgattatccctattctaggattccagaacactgttgctagggtctgaatgtttgtctgtctcataggattccagaataatgctgctggggtctacatgtgtgtccatcccataggattccagaacagtgctgctggtttctaaatgtttctccctcacatagaattccagaacactgcgacaagggtctgatatttgtccataacataggattacagaacactcccacagttgtttgaatgtttgtccctcacataggaatccagaacactgctaatggggactgaatgtttgtccctcacgcaggattccagaacaatgttacgattatattaatatttgtccataacataggattacagaacactcccgcagttgtttgaatgtttgtccctctcaaaggattccagaacactgctacgcgggtctgaatgtttgtccgtaacatatgattcaaggacactcccgctgttgtttgaatgtttgtccctcacataggattccagaacactgctgctgtggtctaaatgttggtccctcacataggattacagaacactgccacgagggtctgaatatttgttcctcacaggggattcgagaacactcctgctgtggtctgaatgtttgtcaatcacataggattccagaacactcctatgaggctctgaatgtttgtccctcacacagaattgcagaacactgcagccaggatcttaatgattatccctactctaggattccagaacactgctgctggggtctgaatgtttgtccgtctcacaggattccagaacaatgctgctggggtctacatgtgtgtccatcccataagattccagaacactgcagctggtttctaagtgtttctccctcacataggattccagaacactgcgatgagggtctgaatgtttgtccgtaacataggattacagaacactcccgctgttgtgggaatgtttgtccctcacataggaatccagaacactgctaatggggactgaatgtttgtccctcacacaggattccagtacaatgttacgattttcttaatatttgtccctcacataggattccagaacaaacctggagggtctgaatgtttgtccctctcataggattccagaacactgctacgagggtctgagtgtttgtccataacatatgattcaagagcactcccgctgttgtttgaatgtttgcccctcacataggattccagaacactgctacgattgtctgagtttcttcctcacctagaattccagaccactgagatgagggtcagaatttttgtccctcaataggattccagaatgctgctgctagggtctgaatgtttgtccctcacttaggattccagaacactgctgctggggtctacatttatgtccgaaacataggattccagaacactgctgctggtttctgagtgtttctcactcacaaacaattccagaacactgcgacgagggtttgaatgtttgtccgtaacataggattcaaaaacactcaagtatttatttgaatgtttgtccctcacataggattccagaacactgctacgagggtgtgaatgtttgtccctcacttaggattccagaacactcctgctgtggactgaatgtttgtccctcagaaagaaagccagaacagtgctaccagggtctgaatatttgtccctcacataggattcaaggaccctgctgctggggcctaaatgtttgtccttcaaataggattccagaacactactacgagagtctgaatgtttgttcctcacaggggattccagaacacttctgctgtggtctgaatgtttgtcactcacatgggattccacatcactgctatgaatgtctgaatgtttgtccctcacaaagaattccagaacactgctacgagggtctttatgactgtccatcacataggataccagaacactgcagctggggtctgaatgtttgtccctcacacaggattccagaacactgctgctggggtctgaatgtttgtctgtcacaaaggattccagagcactgctgctatggtctacatgtatgtccttcacataggattccagaacactgctgctgggttctgagtgtttctccctcacatagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctgtgaatctgcctagtcctggacttttttttgttggtaattttttaattaccattcaatctcactggttgttattggtctgttcagggtatctaattcttctcgatttaagttaagagggttgtatttttccctgaatttatccatctcttctaggttttctagtttatgtgcataaaggtgttcatagtagccttgaatgatcttttgtatttgtgtggtgtcagttgtaatagctcccatttcatttcttagtgaggttatttagattttttctcccttttcttggttaatcttgctaatggaacatcattcaaagctgaccaaagtattttttttaactcctgtcaatatgaacctgtgggttccagttcatatccccattggtgctcaaataacaaacttcaagttggtctctggctacttttgacgtgaatctagtagattttttttaatatatatataataagatattccaggttcatttgtatatttccttacccacacttatattcagccatttctccaaggaacccctgttccttgtagtgaatatggcatttgggacgaaagattgaaatgtaaaaatgatgagtattactaaattgattattttctctcaactttttcagtgtccacaactagaaaatatttgcttaaaagataaagtacatcagcgtttctactgataattacaggatttttacttaacctcatatctttttcctaaatctcttttattccttgccaaaaataacagttccttgatgtaattactcattttctttattacctaatgcttgcacaacaatcttggaataatattgccaatactaataacaacagtgtagttattgcaaacaaacttaacaggtttttgaaaaaaacattttggccttgggatagttactttctctgaagttatgcctggatatacagttagattccattgttgtggtggtggttttagtgattttgagagattttaaaaatttaatatttttataagtatgtaaaatatttacatgggtgcaaagtccaagctacagaaaaagatacattcaaaaataatctagtgtctgtttctatcttctctattctattccctccatcctctatgggtcaatttttaaaaaacaaacatgggctgggtgcggtggctcacgcctgtaatctcagcacttttgcgaggctgaggcagggaatcatgaggtcaggtgttcaagaccagcctggccaagatggtgaaaccccatgtctattaaaaatacaaaaattaactgggtgtggtggtgggcgcctgtaatcccagttactcaggaggctgaggcagagaattgcttgaacacaggaggtggaagttgcagtgagccaagatcgctccactgcactccagcctgggtgacaacgtgagactccgtctcaaacaacaacaacaacaacaacaacaacaacaaaaccaaatgtggttgattcttccattatttttttctttttttttcagctacattaaattacaattgacatataataaataaactgcatgtacttaaaatgcacaatttgatgttttgacagaagtccctctttcctgttttctcatctcctctctctctattcttctgtcgttttttaaagtgtaagcaaatatactttcaatatttatatcctggatttttaaaacattgttgcagaacaattgtacacattttcctccactgctttatcgtctcctaacaatatctactggagattaatttatagtagcctatagagacactccttattccttttgacagctgcatagtactccatcatgggaaggcaccacagtttatacaccagtaccctattgaaggacacctgggttgtatccagtgttgttgtagtttttagtttttttcccaaatagaactcttatgaatcgtcttgtgcaatatctttcatatatttacctgagtatctttgagatattttatggaattgggatagctgagtcaaagaataatgctgctagttattgccaaaccttcacaagacaaatacgagcatgcctattttcacatcatctcacttccagagaatgctatcagattttgaatttttgataatctaacaggtgagaagtatcgtaccatattatttcatttctcttactatgcatgagattgagtatatttatatggtggtaaaatatttgcattttattttcccattaggctgttggtctgttttctatctatttccagaagcctttttttcttcttcttctgtcacccaggctggagtgcagtggtgcaatcttggctcactgcaacctccgcctcctgggctcaggcaatcctcccaccttagcttcctgagtagctgggaccacagaccacagatgcatgccacctcgccattttttttttttttttgcttttttttgtttttttggtagagatggggttttgccaagttaaccaagttggtctcaaattcctaacctcaaacaatccgcctgccttggcatcccaaagtgctgggattacaggtgtgagccaccgtgtccagtctcagaagtcttttatatactattaaccctttgtccgtgatattaattgctagttctttttttattatttagtcatttgtgtttttactttgtttatgatggtttcttaccatacattttttttttttaattttactttaagttttgggatacatgtgcagaacatgcaggtctgttacatagttatacatatgccatgatggtttgctgcacctatcaatccgtcatctgggttttaagcccgacatgcatcaggtatttgtcctaatgctctccctccccttgtccctcacccccgacaggctccagtgtgtgatgttcccctccctgtgtccatgtgatctcattgttcaactcccacttaggagtgagaacataccttgcatctttttaattataaataattgtttttaaatatcaggagggatttaattgcaaaatgttcatgcgcaaaatgttccttgaacactctaggagagacgccctttccctgttacagactgtgtgacttcaatctatctgggcctcaagtaccttggatgtaaagaatttagaaaaattgtgtctacatagcagaatccttgtgaagtataaacaagataacaattatagaggactcagaaaattcctgacacatagtaagcactcaaaaaattataactattagtattgtttcatctttcattggaagtgtacagattaaatacataattgttattttgttcactaatcacaccattctctaaatagttgctaaattctttcctatacatgtttcttatttgtcttgtttaagcttctgtaggacagaaattaaacttgatcctttgtttcttttctccatgtatcaagcaaaatatctccaacatacattgtgagaaaaagcagctttcgagtatgagaaaatctactttcaataacacttcagttaaacacattcagtgggtatcttgacttaccaacaaaatagaacaaaaatgttccttatgatccccatctctgaagaacatgccaacaataatttataaagggacctatcatgccaatgtatttttacttgtaaagcaatgaatcattgcattatatctgtttcaagctaaatagagtcaataacatgaaacaggaatttcagtgggatcttttatatctcactgaccagccacaaaattcaaaggaatcacagtgttccttattatacacaagttacctcctatcaccccccaaagatgaatctttcatcacattttcctaccagcattctatgtaatttatttttaacctctttgagagcagaggagatttagtcatcataaaatctattttcaacttattatccaggagtcaaataaataaagaattaatcaaacaatgtcatgtaatgggtctacacatcagaagacacatcagatgaaggaaggagaatgagagctgattcacttggcttaaccaaattggatagctcagaatacaacaggaaaaggaaatgttgccttttctatttatagaaatatttaccagataaggacaactatctaatttactaaaaaacaactgattctctattagtaatgtgcaaaccacaagattattcacatggtcatagtggttctcagcagggtataaaaagcaaaagagagaacaaggagagatcaaactcagaacactcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtccagctgctgcaggccccagtgctgccagtctgtgtgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgcaggaccacttgctgccgccccagctgctgtgtgtccagctgctgcagaccccagtgctgccagtctgtgtgctgccagcccacctgctgccgccccagctgctgcatctccagcagctgctgcccctcttgctgtgaatccagctgctgccgcccctgctgctgcctgcgtccagtctgtggccgagtctcctgccacaccacttgctatcgcccaacctgtgtcatctccacctgcccccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgtagggccacagatcttaaagcctccaaccttgaagtccagtgaagtctctctcttaaagtcttttgcaaacatttttgtaccttgttatttccatgtaccaaaataaacctctattctattggcactgaaaattgaatatgattcttattctctttttaaaaagggttttatatttaggtcctgggtgattacatttaactacacctgtagggctcacagcacagattagtcaaccttctaacagaggtcaactgacatcgatcactgcctagtttttttctagaaaagtcttttcaggcttaggcaaatcaattagtcattttgtattctttagacaaaaagagtgaagctgaagtcatgaaatatccatgaatataacaacaggggaaacattttgaaagattgatcacaactcatcatcttttaaaaaataatttcaacttttattttagaatcaaagagtacatattcgtatttgttacatgttgtgtgatgctgaggtttgggctacaaatgattctgtcaccaggtactgagcagtgggtcatttttagcccttcctctctccctctctcccccctttttggagtccccagttgttctcatctttgtgtccatgtgtatccaatgtttagctcccatttgtaagtgacaacatgcaatatttggttttctgttcctggaaaaatttgcttaagataatgtcctccagccacatccatgttgctgcaaaggacaaaatttcattcttttttatggctgtgtagtattccatggtgtgaaaatgtcacatgttctttatccaatgcactgttgatgggcacctagactgattccatgtctttactattgtgcacagagctgtgatcttttaaaacactgtatttcaatttctttttttttccagtaaaagcagctattaggtggtttagcaaagtccatgtattttctactgagtcatgtgtaatgaatcctcaacacaaacacagtggatctccttcattctgactggcagagtttcaatggggagttcatgctgccatgtagagagggccaccttcacggccaggcaggtgatggaaatgaaggaagcaggcctagtgaaaactcacaggtatgctggagactgattttttttcttttcgtccaaagtcatgccctttttttaggatgaaactataaagacccacatttctccccaactagggatgcctctaatgggtcatctcatctccagaactccctataggttcatctgagacttccacggagattgccctgcagtttgatttatcccagtgtcaaacttgatctttctctcactttcccttcctttcccttcccttcccttcccttcccttcccttcccttcccttccctttccctccccttccccttccctttccctttcccctcccctccctttcccctcccctgccctccccagtgttaatcccaagagcatgcttcaataaacctcctgcatattgctctccatctcagtgactgcttcctggggaacccagcctgtcccccaaaacaatttgaaattcatgatagctaatttgagagctcaaatgactgactgaaatgtacttttaatattttagttcctgaaagaaataagaatgtaaacataatagcagaaaatatatttaacagaatatgtagaaaaattatgaattttatataaatcacatttattattttctaaggatgtttagatcatttatacacaaatatatgctctttaaacatttagacaatacaaaagaatgtgacaatgtgaacaaaagtaagtttcccatcatgatctttgccaatcccattcaatacctaatgttgcaaattgagatacatcctcattaaatgcatgcataaaacatgtatgtatttatttgaaaacttggctttcgttgcacatctcttgttctgacatttattcaaacattattttatgtccttccggaaatgttaacattttccttcacaaaggcttggcagatttatttacatatttttctatttactcttgagaactgtgagtacatgcttctttttttttttattatactttaagttctagggtacatgtgcacaacgtgcaggtttgttacatatgtatacatgtgccatgttggtgtgctgcacccattaactcgtcatttacattaggtatttctcctaatgctatccctcctccctccccccaccccacgacaggccccagtgtgtgatttttctccattaaattttagagagaattattgctagtgtataaaaagtctatggattagtataagttcatattttatctgatctcgcgattcacactaatacccagctgactctacaggattttacaggtgtgcaatcatggtggccaagtgcctccagcctcaggcttgtccctggggttcgtccccagctgcccacagtgggggccttaccattaacacaaacactgttgggattttctacctttcctgtcttactttcaccgtttcctcacttgtgcttcctgggatcatcccccaaataaattatgtgcactcaggtctttttctcaaggtttgcattgggtagaatttaagctaagacaacagattatcagcaaacatttttggctgactgatacgaaacaggaaataatagttatttcaatcaacaagagtaaaacgaggaagtcaggaggtgaaggagaaccagtgctaccatctggcgtttacttccttcctgtctttttactgtgtgaatataggcatgcacgttcaacactgtattcttggttatctataaacaagtctcattctataaattgaatcttgacttccgcagtttccacgtatgttatttatcaggtgacatgttacctatcacacaaatgagtttagtcttcctgaaatgaaattatgatttctttgtttgggatgttttcctcccttttatccagaagtcaaaagatatatacattttttaaaggaccttacatgcctctatgtcatcaaaaaaaccttcattcactcaacaaacatttaccaccagtgttctctgtgctgagtatcatggtaacgagaataaatgccatagcgcaagccttcagggtatttgcattgcacgtggtggaaagacagaagtaaatgactatgatacaggagaatgtataaattatgagcacaaggcaggaaatcatgatacatgaatggggtagcttagcaggaaagatattattgaggaggaaatattttaactgggtcttgacacatgagtaggagtttgcagagtggacaaaaaaagatgaaacattccaagaagatgaagcagtttcagcaagcttagcaaattgtattctttacggctttcttggctacactaagacatattaggcttactttctctttaaccttggacaagttgtttgtttgtttgttttaagtttttaatgcttcttttgagtattcccctaaaagactaataagaatataaactagttcataaggttctattaaagcgtgaaaatgaaacaaatgtaagatatttggtacaatgcctgctacatagtcaatacttcacaagtaatatacataccatgagggtgtatggaacttatccacatattatacattttttattttagttgtttaatgaaaataattgtaattcttttcatttctgccaaactgtttcctatccatgtgtcttatgcaagtacctgcaagaaaaagttgagggtttatctgttctacacccagagtacccaatagaacatcttggatgcatgttattgaaggcttaataattctaaatattctttatatataacaaatgcttttgtaaatgaaaaatccatcatgcaattttgatgatcaaagattaatcaggctgggtgttgggggctcatgcctgcaatcccaacactttgggaagccaaggcaggtggatcacggggtcaagagatcgagaccatcttggccaacatgatgaaaccctgtctctactaaaaatacaaaagtaagctgggtgtgatggcgcaaaccaccttactcgggaggctgaggcaaaagaatcgtttgaacccaggaggtggaggttgcagtgagcagagatcatgccactgtactccagcctggcgacagattgagaatctgtcaaaaaaaaaaaaaaaagataaatcaaaacttcctactcataatgcatatactgtaagacatacagcaaaatgtgtttttaccctttaaaggcagtgagtcatgggtaagtactttcgctggaggctgtggaataagatctgacagagtttagaacttcttgggatctgaccatctgcccgaccatccgagatgcacacatgggatcagagtcatcctcattacagatgggacatccttccccaaatgagtgcttccttctaattccttcccaacatttcacctgaccaggacattctttgacaacaaaagatacattcacattataaaaatcatcccccatgatttgcagacagcaatctgcaggtaggagggagagtcacatttaaaaacaaaatgtcagagagtcctgtgaccagtgctttgtaaaagacactgcatagaccagggacaaaggtgactccccactaatgaagaaatatgacatgcatttccaatggaaacacaggagcacagcaggaaaaggaaatgggttattttctctgttttggagtatttaactggaaacacaatgatgtaattacatgattaatttttccagtaggtaaataataacaaggaaataatgatgtggtggcaatgggccttcaggagggtataaagggactacaggcccaggagacttccaaacacaagaacttcactctcctagaaacccaactagatccttcaccctctgacaccatggtaaactcctgttgtggctccgtgtgctctcaccaaggctgtggccaagacctctgccaggagacctgctgccgccccagctgctgtgagaccacctgctgcaggaccacctactgtcgccccagctgctgtgtgtccagctgctgcaggccccagtgctgccagtctgtgtgctgccagcccacctgctgccgccccagatgctgcatctccagctgctgtcgccccagctgctgtgtgtccagctgctgcaagccccagtgctgccagtctatgtgctgccagcccacttgctgccgccccagatgctgcatctccagctgctgtcgccccagctgctgtgtgtccagctgctgcagaccccagtgctgccagtctgtgtgctgccagcccacctgctgccaccccagctgcagcatctccagctgctgccgcccctcttgctgtgaatccagctgctgccgcccctgctgctgcctgcgtccagtctgtggcggagtctcctgccacaccacttgctatcgcccaacctgtgtcatctccagctgcccccgccccttgtgctgtgcctcctcttgctgctgagcccactgccctggctcatctctcccttcactgcaggcccacagttgtagaccattcttctgtgctgactattaggacacatggagtgggattgatgtcattcagcagggtggacttcatgtttccaatgagcccatcaccatcccactgactctgtgagaacattctggttcattttaaactccctcccttgctttctttctcttccagtcatggcaccaaatatgaaataatttgtaatccactagctaagaaattattccaatcctctaaattcctcattttttaaatcgttttgagcctacagaatatccttcccagtgaggtacacattatctccatttcaaacatattatttgtctgtcagcctttcagtcattcttttctcttggaaaggtaggaggctgcccctcccatgctctcctgctttctccctgttctctctttgtctctgtttgttcaagtttgccagaatttttctattttattggttctttatctttattgtgttcacaaaatatattgtattaaacttttcatttagaaatcttttattgttttttgcatttttttgtgataattttcactgagtttactgattcatgggggtgaggtgggaatgcagtagaaggggattctcaaagcatgattccaaagtaagacttcaaggatgaactcatagtgccaaactgctccaatgtcacgcataaactaaaataaaatagaagcttttgattgtttcaatttgatatatggaatgctttgggataggtaaagccccagtattgttgtttgtaagttcatccatgattttagaacttatgatatcatggtaatactcctcactcttctgtgtcaaatttaaaaggcacatctcatcctactgcattccatcttgattcaaatcagttaaggcagactccaaatgttatataagggaattttgttattttgttgtcggtggaccagttcaggttcttgaatttgctgtgcaaaagaatttgagagcaaatccaaagtaagagtaagcgaagaaatttgttgcaaagcaaaagtactctttgagaggcagagtggggtgctcagtgggagagacagcagctagtgctgtaagaggaattccttttatgggagctatacgtacataatcataaaatactggtgaggtcaagtatgcaaaggcagacctgcggttggcacatgtgctcaggatccacgtggtctaacacccatcgcatgtatcattagcatatgaaatctccgccttggggtgtttttcttgttgtggttgtttttactattaaaatgaggaaatggttactataagctgaaccttgatcctagctgtgcatgcaggaccccagagaagtccctgcccaccctcccaaacaccccaccccaggaaggaatttgtagttaggagtttcttgggcttttggtgcaaattggctagagattggggaagctgcatcaggaataaagggcttttgctctctttcccaggttgtactaggtatcaggaacttgtaaccctctggtgggtctgcttcgattctgtaggaccccttatcttgtgaaagagttaggcactgatgcacaaaggttcaagtgaaaagagcttgctgtgaaaggatcctgctgggcttcacacaggggacaagtcagtatggccttgtgaacccccaaaatcggagacaggtctcagtttatttagaaagtttattttgccaaggttggggatgtacacctgtgacacagcctcaggaggttctgaagacatgtgcccaaagtggtcagagcacagcttggttttatacattttagggagacatgagacatcaatcaacatatgtaagatgaacagtggttccgtccggaaaaggcgggacaagtctaagcggggaggggcttccaggtcataggtagataagagacaaatggttgctttctttagagtttctgattagcctttccaaaggaggcaatcagatatgcatttaactcagtgagcagaggggtgactgtgaatagaatgggaggcaggtttgccctaagcagttcccagcttgactttcccctttaccttagtgatttcagggccccaaggtttattttcctttcaaatttccccccttttcttaaaaatctttttgagaaagcctttttgaagaaagtcagtctttggtctcaagtttcatctgatatctcatggctaggattgtttattcctagaaagataattcctgagttattaggaaagttcatttttagcaggttgtgaagtttcatgtcctatgaagagaaaatagggggaggaagggagaaaaacaaaaataaacaaaagaacaatcctggaaaatcaatatgggccacattactctgaagtccatacatcagtaggcaggtatgaaagtggcttatgtatgtaaacaggttgctggtattttcttctgaagtttaaattctctagctccagttcgcagggcttttacaaaagcacagatgagttttcagtgactccaaattaggaaaaatgggggaaagaagaagaaaaaaaaactgaaaacaatcttttgaagacctgtagccaagaaaaattagaattcagtcgaaactgtagaaaataataaaaatgtgaaaacattaggcaagactagaatctaacaacaggtgtattatcattttttgaaacataattcttctctctcccatttcccatttttactaaagacaaatcatggcagggctgattttctttattatacttgacctgattatttgtatacagcgcagccatagtaatactttttttttgcataagcttttaaattgcctttgatggaactgaagcaggatgtttccctgacccctttgtgggacttgtgacgggtgcctcgtttattcagcctgccactctcaactccttgcaggagcgagcatgcaagcaaatgaggcaggaactggagtgcactgtgctggaatcggcactgcagcacggtaggatcaaacttcactcactgggacctgctgcagtcccctgcttgtgggaggaagcatgcaggtgaatcagtgcaggagccaaagtgagtgcttttggccaccggcaggagcaaactctgtgtgggccccacagcagcatctaggtgggggtgcctgcgacccccatagccccagagggcatgttacagtgttcttttaactctgccttccatggatggcttaagtgtcaacagctcagtgaggcctctgcctttttgtgtgaggcagctgccctccaccagcaagggcagagggccagtgtgacagtcttttgtatctgctctcctggctcccaagctcttgtcttgtgtccaggaaaagtgaggtcacatgaaccaatcaaaggatggtaaatgtgggggattttgttgctgatgaaagtggctcttagcagaaaggggagctgaaaaaggatggggtgggtaggtaatcttcctcaaagttaggctgtatccagctggattcttctccaagattacaccatcaagctgtccctctgaatcaagctgcttctctctgacgtccagctgtagttcccaatgtccagctgcttcttgcctctgccagctgagtctggcatcttcacaggcataggatggacaggatggagccatgagtggtttagaaaaaggcaactttcaagcaggaaaacagggatataagttctcactttgggccgtggtttaaggcttttcagcttgaaggtggggttttgtcagagacctacccttttctgcctagaatttctcagccccctgtctctatcagaactttgttccatagaaggaatttcggataagacttttggaaagcttagcctagccatggatttgtaccatcaaatacctatgagttgcatgaattcctctgctcttgaggttccaagataaacttggggctcctggaactgttagaaagtgacatgctttacttaccacaggtcaggaaccctgtacagggactgtgtagataaggtatgaggccagttctcccaaggggcttttattggctccataagtcaaatttgattccttaaaggagagcacaccattccagtcaaagccttggtaaaatgaccaatttctccaattgtgtcttgttacacatgaaaacagattattattgcacttatgcaaataactgtattgccataagttaagaatactcacagatagtttccaattctggggaaaatcaggtagagagaaacaaatatgctccaaatatttttcacaggagtatactaacttgttaaaagctgacaacagctcaaataaaagtttccttgactaaaaaaaggaaaacaaggagcagcaacattttaagcaaaaagtcaaaaagattacgttgctcttctattagttcagttcatgcagttaattcctgttctgcttgctattcatgaacatttcaggtctccatgagttctgaaagcttttcctccattctgatgtcacagtctccaaagttattagaaacttgccttcaagaacacgtgttagagttttatagctgattataaaaccatcttctaaaaaggactaaaacaaaacaattgtccatgggtgacaaaaagttttaggtcagccataatcaaagacacaattgacaagaaaatttgttaccactgtggcacacgataattttatataacaattataattattagtgatattgtacaccatgtcatatcagaattataggagtttcccataattttggtgcacataccaataacatttttatacaaatacagcccaaagaaaaccaaacaccattttatatttgacaatgcttcctgtataatttttataccaaataagtcatttatttcatttttggactttagggaaactaatatcttagaggattaattaggtcagaaaaatacacaacttgtaatttgattctggaaactttgccaaatatcaaaagtttaaaatacttgataggtcatcataaaataagtcaatttttcaaacattaagcccaaataaaacagcataaagccaattaaatttgttttttgaaattttattatcaatctttaaaattttaatcttgaccataagatacagcttccataagccttttttaacctttataacctttattaaggggtcggttaacacttcaagaaaacctttttaatctgatgcaggggcccgtatgctggtattgcatcagtgtgcctttgacatcaattattaacttgcagagaaactgaacttattttgtctctcaaaatcagcccttacaatctcacatgcctacctcttctgtggtagttcctgagccttgaggagttgaatagcttttacttctggccttatgtctcaggaatgcagtttattttgattggcatcttctaccaggcctgaagatgaggttttaattgctgtcagtgcttaagatttagcagaccttggtgtccttgttagacccaggagtcaaaggcctgtaacttaatgtcacaggtactttcaaagcacctacagaaatatacatggatgtaataaccttaattttaaaaaattatctcagatactttttcctgagcaaatcaaaaattaataataacagcataacattgtttcaataagccataaaatctgttaggtcaattacccaaaggcaaaagaaaagaccttctacactgcacagaatattactttggaagaaaacattttctttagacttttagaaaacattgttagcatcagaccataacaaatagaatttaaggaaaataacttatatgagctgcaaacgagttgaaggggagagaaaacagcgagtaaacagttgaactttgggttaaaaaaattaaaatctcttataatttaataagagtaaatcaatcccttaagaaaatttcatcgctctaactattttgtttatcagtgcttttttttttttacatgaagcccaatcttcaggaagactattataatttccttttaattacagacaacttgaccatataaaagtttgttggttttttttttaatcctcttattatgacttttacagactgttcatgatatgcttggactttctggtttgttttgaacatccatctttcttaaacaatcattttattttaggtctaaatttaccatacaagatcttttctcatatgaaattatttctctttaagcttccttaccaaaaagaaccctctttatcctctttatttttatacctttctttacatctctctgatttcctggttccttttaacttgtcttatacataatctttaaataagcattgaattagatgacaattgttcacctttttaaaaaggaattgtttacctagattatttatgaaaactgcaatagtcatcatttaaagttatggaactgccattgcaaaattataactgagacagtgaaaaagatctgacctaattgactccatcttgcttctaacctccaaactgttcttgttcaatcctgggcacaggctgaacagacgttgagaggaacatagtttatagtttacctttgaaacaaagattataacagttcattctcaaactaaatcttactgcctgtggactagaccaccaaaaccacaaaattagaagttacagtaatctcactaaattcaagatgtgactatttttattaaaccaatatcaatgtcttatttattaaagattatacaagcaaagatcattctattacagttttgtaactccatggcaaattttgacaccttatggtatttgacagggataagcatgaaattgcttgattaataaatgcaaacaaaaatgcatgctggcaatttttaagacatgtctaatattactttaccaataattttaaagctagcttatttattaaagattttacttgttacataaacttcagaaagcattcaactagtcttttcttttttcctgataaagtattagattcaagtgctttttatcttaagccaattaattagaactcttttatatattttcagtagcgagaaattgtgtacacatcacataaatatatagacatagtaggcatgctgatagaagtacatcgtatagatacttaaggagcttttttcccctatcttaggctttcaaattcttaataacctgttttactcccctagggagttgtcagctaaatagccttaagtttgcatgttaaaggaaacaactcaggcaaaaatcaaatagcaaaattatatcataaggtacagagagaaaaagtctggtggtgctagagggaagtcaaaatggatttaattgccaattaaacataaaattataaaaattataaaggccttttaaatagatacacacacacacacacacacacacacaaacacacacacagaaatcctatagcttttacttcagaactttagccatgagacaaatacaaattcaccaggttgcaaacaaaaagcctgttgtatccaaacagtggttttgatcttaatagaaaaataacagcagatttaaagcaggcagaaaagaaaatagagaaaaaagagaacttaggaactctgtagtttgtaggttgaccttaaggctcttcttttctttctttttcttttctttctttctttctttctttctttctttctttctttctttctttctttcttttctttctttctttcttgcttgctttctttctttcttgcttgcttgctttcttgcttgcttgctttctttccttcttttctttctcttctaaaaaaaatgaaatacacatgcaggagaacgtgcaggtttgttacataggtatatgtgtgccttggtggtttgctgcacctattgacccatcctctaaattccctcctctcattccccaccccccaacagcccctgatatgtgttgctctcctctctgtgtccatgtgttctcaaagttcaactcccatatatgagtgagaacatgttgtatttggtattctgtttctgtgttagtttgctgaggatgatggtttccagcttcatccatgtccctacaaaggacatgatctcactccgttttatggctgcatcgtattccatggtgtatatgtaccacattttctttatcaagtctataattgatgggcgtttgggttagttccatgtctttgctcttgtaaatagtgctgcaataaacatacatgtgcctgtgtctttatagtagaatgatttgtattcctttgggtatataacaagtaatgggattgctggatcaaatggtatttctgattctagatccttgaggaatcaccatactgtcttccacaatggttgaactaatttacatgggccctttctttcttaatgtaaatatgcacaaagaccatattacttccattttacttaaactctggcaagtacaggtgccataaaacctatggagtgcttgaaagggaatcattctctttgctttctcctcattcttagattatttgtttcccagttttcttcttaaaaagaggaactgagctgaggcttagaggttttctgtggtggatcaatatgtgccatttgtgggcaggactccacagtgggtcaccactgaaaacaacagttcagttcctcatgcaaatgcacacagacaagctgaattgagcttaatttggggagaaaaagcaacagagaagatcctttagaatgcatttgtgaactagaattaggatctttaaatgacaaattcctagaaggaaaacaaaacaacagccaagaccactttttgtaaaccttgctcagccaccccttaactttgtagctctcatctaccactatacacaacaaggtcaaagccaaagaggtcaggtcatgcaatacaggaaaatagaggtttagagttaagaagaatctacccatgactcttgaaactccacaaagaaaacaaaacaccccaaaaggggtgagtggcaacctttgttctgaattctttaagggggttcaagtcattagaagccttctctagactttttggtactgcatatggcaaagggggaggaggtatatggtgcaagaaaagtaaacgaaagaacattcgtgttttaagacaggaagcaaacacagaaaccaagtgcatgggtttttggttctttttgtttgttttcttcttttgcagctgcaatgaattttagccaaattagagaggttttgttacccgtaattttgaattctcacttggatttgaccaagtcaggtagagttggtcaagtctgatgggagaaagaccaaaacaaacaacaaaatctccaaccataggattaccaagcactctaatgataaggagaaattaagagcagctagctggttgttaaactttagcccagacaaagccccagttcagctacttacctagggatgggtctcaggctgaaggctgctttctaccaccctagaagcaggaaaaaaactcaaactggtcttccctgctgggagtgagctcaaactctacatgcctttcatcatcatggaagcaggaaatcttgccttccttgtaaaggaagtaaaagtaaatcttgccttccttataaggaagtaaaagtaaatcttgccttccttataaggaaggcaagtaagcaagtaaaactccaaaaacaaaaataggtggggcagttgtacagcaaaatgaactttagttcttcaccaaatttggggagatcagggattctttggggagggtgctcccagacctcagcaaattgtcctattgatttgagccataaagttagctcatgctattaccaggcaccaacaggatattcgtcaaaggtcaagggcatctccactcagaatcctttcacagttaccaaaatgttaacccagaaaatctgagacaggtctcagttaattgagaaagtttattttgctaaggttgaggatgctccggtgacacagcctcaggaagtcctgatgacatgtgtgtaaggtggtcagataacacttttgttttatacattttagggagacatgagatatcaatcaacatatgtaagatgaacacggatttggtccagaaaaggcaagacaactcgaagcaaaggcgggacaactcgaagctgggagggggcttccagatcataggtatataagagacaaatggttgccttcttttgagtttctgattagcctttcccaaggaggcaatcagatatgcatttatctcagtgagcagaggggtgactttgaatagaatgagaggcaagtttgtcctaagcagttccgagtttgccttttccctttagcttagtgatttggggaccccaatatttattttactttcacagcctcctaaccttatttatcctgcctcatgtttaagaaggcatcataactctatgactgagatctggacaacatttttcttaaggcatctgaaaaaatatgaagcttatttttcatatttgaacatatctgaacaaatcatcttaaacttgattggctcaatagcttaaggccatttcagagctgataatagtcaaataaaagtaaaaacatcaagagcaggtgctcctactagaatgccaagttatagtcacttaccatattctttcagattcaaatgaaggcacctctcttggaaattctaattaggatatgcaccccagctgcgacctactcaagactgaactaattccaataaaataattcttaaaaagaaaagcgagccttgaaattttcatcctttctgggtttatatatattaaaatgttaagtgtggagttgtttaaattataatgtaaacccgtagagaccacagtcagcaatataccatgctatccagatgaactacagctcaatatgcttttttgtctcagcagaactcactgggaaataaagcccactttttgattataaattccaaaatgttgttattgagtaaaatgaattcagtacatgaaattctttatagaagatttcccttctttcattggtgtctaattttcagaaatttggttttatcttttttgtcaaaacagggacgatagtattatgagatataatgtgttaaagataaaatgtgtttcaagagctaaggtatgaattaaaactgtcttaatttaggatattaagacacatgtgcacacacacacacacacatacacacacatatacacacagcacttctattccaataccgtaaattatctatattcgatatagcatgtatcttcaaagtgatttcaacacgggttgcttttcctgcatctttgtgtaaaatataattgtcagggaatcagtaaaataattatgaaagcaatagagaatgataccaatgaattcttatgtacagaaattttattaaaaagcagagatgcaacaaagcataagaaattcacactaggagaaacacagaatataactgggcggctggatctgagggtgcaacctcagtgacaaaactggtcctgcagataatgtctgcctcactgagaagaagatctgtacctcaaagtgataaagaaaatgaggaaattagaggattggaataatttctagctagtggattacaaattaattcacatttggtgccaccaccggaagaaaaagaaagcaagggagggagtttaaaatgaatcagaatgttctcaaagagtcagtgaaatggtgatgggctcattggaaacatgagttccattctattgaatgacatcaaccccacttcctgtatcctaatggtcagcacagtagaagggtctacatctgtgggccagtggtgaagggggagataagccagggcagtgggctcagcagcaagaggaggcacagcacaaggggcgggggcagctggagatgacacaggttgggcgatagcaagtggtgtggcaggagactcggccacagactggacgcacgcagcagcaggggcggcagcagctggattcacagcaagaggggcggcagcagctggagatgctgcagctggggcggcagcagttgggctggcagcacacagactggcagcactggggcttgcagcagctggacacacagcagctggggcgacagcagctggagatgcagcacctagggtggcagcaggtcgtctcacagcagctggggcgacagcaggtgggttggcagcacacaggctggcagcactggggcctgcagcagctggacacacaacagctggggcggtagcaggtggtcctgcaacaggtggtctgacagcagctggggcgggaacaagtgggttggcagcacacagactggcagcactggggcctgcagcagctggatacacaacagctggggcggcagcaggtggtcctgcagcaggtggtctcacagcagctggggcggcagcaggtctcctgacagaggtcttggccgcagccctggtcagagcacacggagccacaacaggagctgaccatggtgtcagaacggggaggatctgggtgggttttcaagagagtgaagttcttgggtttggaagtcttctgggtccatagcctcctttataccctgctgaaggcccattgccaccacgtcattatttccttattatttacctcgtggaaaacttaatcatgtaattacataattgtgtgcttctacttaaatactccaaaagagagaaaataacccatttccttttcctgctgtgctcctgtgtttctattggaaacacttgtcatatttcttccttagtgggggtcacctttgtccctggtctctgcagtgtcttttacaaagcactggtcacatgactctgacactttatttctaaatgtgattctccctcctacctgtagattgctctctgcaaatcatgggggacaatttttataatgtgaatgtgtcttttgttgtcaaataatgtcctggtcagatgaaatgttggaaaggaattagaaggaaggactcattcgggagaaggatgtcccatctataatgaagatgactctgattccgtgtatgcttcttgaatggttggggagatggtcagatctcaaggaagttataaactctgtgtcagatctcattccaccactccaagtgaaagtacttagccatgactcattgcctttaatgagtaaaaacacatttttctgtatgtcttacagcataggcatttggagtaggaagttttgatttacctttgatcatcaaaactgcatgatggattttcattgacaaaagcatttgttatatgtaaacaatatttagaattattaagccttcaataatatgcatccaagacattctattgggtactctgggtatagaacagataaaccctcctctttttcctgcaggtacttgtataagacacatgcataagaaacagaatttggcaaaaatgaaaagaattacaattatgttcattaaacaactaaaataaaaatgtatagtatgtggataatttccacacaccctcagtgtatatatatattacttgtgaagtattgactatgtaccagacattgtgctaaatatctttttcattttcactctttaatacaaccttaaaaagtaggtacattcttattactcttttagcagaatactcaaaagaagcattaaaaagctaaaacaaacaaacaaaatacttgtccaagattaaagagaaagtaagcctaatatgtcttagtgtagccaagaaagcgataaagaatacaatttgctaagcttgctgagactgcttcatcttcttggaatgtttcatctttttttgtccactctgcaaactcctactcatgtgtcaaaacccagttaaaatatttccttctcaataatatatttcctaataagctaccccattcatctattattatttcctgtcttgtgctcataatttgatacattctactgtatcatagacatttacttctttcattcccccatatacagtgcaaataccctgaatgcatgggctatgatgtttctttttgttaccatgatactcagcacagagaacactggtgataaatgtttcttgagtgaatgaaggctttttgatgacatagaagcatgtaaggtcctttaaaagtgtatatatcttttgacttctggataaaagagaggaaaacattccaaacaaggggatcagagtttcatttcaggaaaactacacttatttctatggtaagtaacatgtcccctgataaataacatatgtggaaagttgtggaagttaggattctgtttatagaatgagacttggttatagataaccaggaataccgtgtcttcccactgtggaaggaaaaagagagggtgagacagagaaagagggagtcaaactcatccttttataaggaaccctcttttgtgataacagcattaatccactcatgagggtggtgtcaccatgacccaaacatctcctgttaggcccaacctcccaacactgcggcattgaggatcaagtttccaacacatgaactttgagggacacattcaaaccattgcattccacccttggtcccccaaatccatgtccttctcgtacacaaaatatattcattttattccaatagtcccaaagtattaacttgttccagcaccaacttaaaagtcaaaatgtaaatctaagagtctcatgtgactctgatatgaataagactcaacacaggacttatcctgaggcaaattctcctccatatgtgaacctattaaagacgttatctagttccaaaatccaatggtgggagaggcataggatagacaggcccattccaaaaggcagcaacaggaaagaaaaaagggtaactggccccaggtgagtccaacagggaagacagcattaaatcttaagactggagaataaacttcgactccatgtgctgtctcctggatgtgcccgacatggggaagggctgcctggggtcttggtgttaggccccaaatgccctcagatagccctgccccatggctttgctgggctcagcccatacagcagctatctgattggagtctctgctgcagctctctcaggctagtattgcaggctgatagttctacagttctagggtctcagtggctgctctgaccccccgttttcctgagcatggccctaggaggacctctctgctgtggctacacccctaaggcaggctgtcagaaacatcctttcaaacctaggtggaccaccattgccccacaactcctgcagtctgtgtatctacagtcagtactacatgaacaccaccaaggctcacagtttgtggcctctgcagcagcagcgcaagtctcatctaaacccacttgagccacaactggagcagcaaaggggcaccgtgctagaatgtggagagtaccaaaccctttctgaccttaagattctctcatttggagcctgtgatgggagggacagcttcaaagatctttgaaatgccttcagagccattctcccactgatttgatgaacagcacctagcttccttctattcatatcaatccttgtaacaaagcattacttggccacaatcttgcatgctttttcattctttatatggtcagtctccacattttccacatctttatgttctgtttcccttttaattatgaattccatctttaaatcatttctttcctcttgcattttactatgtgcagttcaaagatgccatgcagccccagtgcttccagtctgtgtgctgccagcccacccaactgctgtcaccccagctgttgtcagaccacctgctgcagaaccacctcctgctcccacagctgctctgtgtccagctgctgcagaccccagtgctgccattccgtgtgctgccagcccacctgctgccgccccagctgctgtcagaccacctgctgcaggacgacctgctgccaccccagctgctgtgtgtccagctgctgcagaccccagtgctgccattccgtgtgcttccagcccacctgctgccaccccagctgctgcatctccagcagctgctgcccctcttgctgtgaatcgagctgctgctgcccctgctgctgcctgcgtccagtctgtggtcgagtctcctgccacgtcacttgctatcatccaacctgtgtcatctccacctgcccccaccccttgtgctgtgcctcccctccccttcccctccccttcccttccccacccgttcccctccctttcttcctttcccttgccctcccctcccctccccgcccttcccctcccctcctctccccagtgttaatcccctccccttccccttccccttctctcccttcactttcccctcccctcccctcccctcccctcccctcccctcatttccccagtgttaatcccaagagcatgcttcaataaacctcctgcatattgctctccatctcagtgtctgcttcctggggaacccagcctgtcccccaaaacaatttgaaattcatgatagctaatttgagagctcaaatgactgactgaaatgtacttttaatattttagttcctgaaagaaataagaatgtaaacataatagcagaaaacatacttaacagaatctgtagaaaaaattatgaattttatataaatcaaatttattattttctaaggatttttatatcatttatacacaaatatatgctctttaaacatttagacaatacaaaagaatgcaaccaaaggtaagtttcccatcacggtctttgccaatcccattcaatacctaatgttacaaattgagatacatcctcattaaatgcatgcataacacatgtatgtatttatttgaaaacttggctttcgttgcacatctcttgttctgacatttattcaaacgttattttatgtccttcaggaaatattaacactttccttcacataggcttggcagatttatttacatatttttctatttactcttgagaattgtgagcacattgttcttttttaaaattattcttaaagtcctagggtacatgtgcacaatgtgcaggtttgttacatatgtatacatgtgccatgttggtgtgctgcacccattaactcgtcatttacattaggtgtttctcctaatgctatccctccctcctccccccaccccacgacaggccccactgtgatttttctccattaaattttagagacaattattgctagtgtataaaaagtctatagattagtataagttcatattttatctgatctcatgattcatactaatacccagctgactctccaggattttgtaggtgtgcaatcatggtggccaagtgcctccagcctcaggcctgtccccggggttcatccccagatgcccacagtgggggtcctaccattaacacaaacactgttgggattttctaccttttctgtcttactttcgccatttcctcacttgtgcttcctgggatcatcccccaaataaattatgtgcacccaggtatttttctcaaggtttgcattgggtagaatttaagttaagacaacagatgatcaacaaacatttttggctgactgatacgaaactggaaataatagttatttcaatcgacaagagtaaaacgagggagtcaggaggtgaaggagaaccagtgctaccatctggcgtttacttccttcctgtctttttactgtgtgaatataggcatgcacgttcaacactgtattcctggttatctataaacaagtctcattctataaattgaatcttaacttccacaactttccacatatgttatttatcagatgacatgttacctaccacgtaaattagtttagtcttcctgaaatgaaattatgatctctttgtttggaatgttttcctctcttttatccagaagtcaaaagatatatacatttttaaaggaccttacatgcctctatgtcatcaaaagccttccttcactcaacaaacatttaccaccagtgttctctgtgctgagtatcatggtaacaagaataaatgccatagcccatgccttcagggtatttgcattgcacgtggtggaatgacagaagtaaatgactatgatacaggagaatgtaacaaattatgagcacaaggcaggaaatcatgatacatgaatggggtagcttagcaggaaagatattattgaggaggaaatattttaactgggtcttgacacatgagtaggagtttgcagagtggacaaaaaaagatgaaacattccaagaagatgaagcagtttcagcaagcttagcaaattgtattctttacggctttcttggctacactaagacatattaggcttactttctctttaaccttggacaagttgtttgtttgttttaagtttttaatgcttcttttgagtattcccctaaaagactaataagaatataaactagttcataaggttgtattaaagtgtgaaaatgaaacaaatgtaagatatttggtacaatgcctgctacatagtcaatacttcacaagtaatatacataccatgagggtgtatggaacttatccacatattatacattttttattttagttgtttaatgaaaataattgtaattcttttcagttctgccaaactgtttcctatccatgtgtcttatgcaagtacctgcaagaaaaagatgagggtttatctgttctacacccagagtacccaatagaacatcttggatgcatgttattgaaggcttaataattctaaatattcttcatatataacaaatgcttttgtaaatgaaaaatgcatcacgcaattttgatgatcaaagattaatcaggctgggtgttgggggctcacgcctgcaatcccaacactttgggaagcaaaggcgggtggatcatgaggtcaagagatcaataccatcttggccaacatggtgaaaccctgtctctactaaaaatacaaaagtaagctgggtgtggtggcacacacctgtagtcccagctactcggaaggctgaggaaaaggaactgcttgaacccaggaggtggaagttgcagtgagccgagatcatgccactgtactccagcctggtgacagagggagaccccgtcagaaaaaaaaaaaaaaaaagataaatcaaaacttcctactcttaatgcctatactgtaagaaatacagcaaaatgtgtttttaccctttaaaggcagtgagtcatgggtaagtacttttgctggaggctgtggaataagatctgacaaagagtttagaacttgttgggatctgaccatctgcccgaccatccgagatgcacacacgggatcagagtcatcctcattacagatgggagatccttccacaaatgagtccttccttctaattccttcccaacatttcacctgaccaggacgttctttgacaatgaaagatacattcacattataaaaatcgtcccccattatttgcagacagcaatctacaggtaggagggagagtcatatttaaaaacaaaatgtcagagagtcctgtgaccagtgctttgtaaaagacactgcatagaccagggacaaaggtgacccccaccaaggaagaaatatgacaagcatttccaatggaaacacaggagcacagcaggaaaagaaaatgagttattttctctgttttggagtatttaactagaaacacacaatgatgtaattacatgattaattttttcagtaggtaaataataacaaggaaataatgacgtggtggcaacgggccttcaggcgggtataaaggggctatggacccaggaaacttccaaactcaagaactttactctcttggaaacccaaatagatccttcaccctctgacaccaatggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgccgccccagatgctgcatctccagctgctgtcgccccagctgctgtgtgtccagctgctgcaagccccagtgctgccagtctgtgtgctgccagcccacctgctgccaccctagctgctgcatctccagctgctgccgccccagctgctgtgtgtccagctgctgcaagccccagtgctgccagtctgtgtgctgccagcccacctgctgccaccctagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccacctgtccccgccccgtgtgctgcgcctcctcttgctgctgagcccactgccctggctcatctctcccttcgccgctggtccacaaatgtagaccattcttctgtgctgaatattaggacacatggagtgggattgatgtcattcagcagggtggacctcatgtatccaatgagcccatcaccatcccgctgactctgtgagaacattctggttcattttaaactccctcccttgctttatttttcttccagtcatggcaccaaatacgaattaatttgtaatccactagctaagaaataattccaatcctctaaattcctcattttttaaaatcattttgagcctacagaatatccttcccaattaggtacacattatctccctttcaaacatactatttgtctgtcagcctttcagtcattcttttcttttggaaaggtaggaggctgcccctcccgtgctctcccgctttctccctgctccctctttctctcactgttcaagtttgccagaatttttctattttattagttctttatctttattgtgttcacaaaatatattgtattaaacttttcatttagaaatcttttattgttttttgcattttttgtgataattttcactgagtttactgattcatgggggtgaggtgggaatgcagtagaaggggattctcaaagcatgattccaaagtaagacttcagggatgaaatcatagtgccaaactgctccaatgtcacacataaactaaaataaaatagaagcttttgattgtttcaatttgatatacggaatggtttgggatatgtataacccctagtaatgtcacagataaactaaaatagaagagaagcttttcattgtttcaatttgatatacggaatgctttgggataggtaaagcccccagtattgttgtttgtaagttcatccattattttagaacttatgatatcatggtaatactcctcactcttctgtgtgaaatttaaaaagtacatctcatcctactgcattccatcttgattcaaatcagttaaggcagactccaaatgttatataagggaattttgttattttgttgttggtggaccagttcagattcttgaatttgctgcgcgaaagaatttgagagcaaatccaaagtaagagtaagcgaagaagtttgttgcaaagcaaaagtaccctttgagaggcagagtgggctgctcaatgggagagacagcagctagtgctgtaaaaggaattcctctcatgagagctatacgtacataatcaaaaagtaccggtgaggtcaagtatgcaaaggcagacctgcggttggcacatgtgctcaggatcaacatggtgtaacacccattgcatgtatcattagcatatgaaatctccgcctaggggtgtttttcttgttgtggctgtttttactattaaaatgaggaaaaggttactataagctgaaccttgagcctagctgtgcatgcaggaccccagagaagtccctgcccaccctcccacacaccccacccctggaaggaatttgtagttaggagtttcttgggcttttggtgcaaattggctagagattggggaagctacatcaggaataaagggcttttgctctctttcccaggttgtactaggtatcaggaacttgtaaccctctggtgggtctgctggtattccgtaggaccccttatcttgcgaaagagttaggtgctgatgcacgaaggttcaagtgaaaagaacctgctgtgaaaggctcctgctgggcttcacacaggggacaattcagtatagccttctgaacccgcaaaatcagagagaggtctcagtttatttagaaagtttattttgccaaggttggggatgtacacctgtgacacagcctcaggaggttctgaagacaggtgcccaaagtggtcagagcacagcttggttttatacattttagggagacatgagacatcaatcaacatatgtaagatgaacagtggttccgtccggaaaaggccgggacaactctaagtggggaggggcttccaggtcataggtagataagagaaaaatggttgctttcttcagagtttctgattagcctttccaaaggaggcaatcagatatgcatttatctctgtgagcagaggggtgactgtgaatagaatgggaggcaggtttgccctaagcagttcccagcttgactttcccctttaccttagtgatttcagggccccaaggtttattttcctttcacatttccgcccatttcttcttaaaaatctttttgagaaagcattttagaagaaagtcagtctttggtctcaagtttcatctgatatctcatggctaggattgtttattcctagacagataattcctgagttattaggaaagttcatttttagcaggttgtgaagtttcatgtcctatgaagagaaaatagggaaaggaagggagaaaaacaaaaataaacaaaagaacaatcctggaaaatcaatatgggccacattactcggaagtccatatatcagtaggcaggtatgaaagaggctcaagtatgtgaaaaggttgctaatattttcttctgaagtttaaatcttatagctgcagttcacagggctttataaaagcacagatgagttttcggtgactccaaattaggaaaaatggtggaaagaagaagaagaaaaaaactgaagacaatcttttgaagacctgtagccaagaaaaattagaattcagtccaaactgtaaaaattaataaaaatggaaaaacattaggcaagactagaatctaacaacaggtgtactatcattttttgaaacaattcttctctctcccatttaccatttttactaaagacaaatcatggcagagctgatttgctttattatacttgacctgattattgtacacagcacagtcatagtaatagtaataatttttttgcataagcttttaaattctctttgatggaagtgaagcaggatgtttccctgacccttctgtgggacttgtgacagggcctcatttattcagcctgccactctcacctccttgcaggagagagcatgcaagcaaatgaggcaggaactggagtgcatgagtgctggaatcagcacttcagtgctgcaggatcaaacttcactcacttggacctgctgcagtcccctgctcatgaaaggaagcatgcaggtgaatgggtgcaggagccagagtgagtgcttttgggtgctggcaggagcaaactctgtgcgggccccacagcagcatctaggtggaggtgcctgcaactcccatagccccagaagtcatgttacagtgctcttttaactctgccttccatggatggcttaagtgtcaacagctcactgagccctctgcctttttgcatgaggcagctgccctccaccagcaagagcagaaggccagtgtgacagccttttgtatctgctctcctggctcccaagctcttgtctggtgtccaggaaaggtgaggtcacatgaacctatcaaaggatggtaaatgtgggggattttgttactgatgaaagtggctcttagcaggaagagagctgaaaaaggatggggtgggtaggtaatcttcctcaaagttaggctgtatccagccggattcttctccaaggttacaccatcaagctgtccctctgcagtcaagctgcttctctctgatgtccggctgtagtccccaacatccagctgcttcttgcctctgccagctcagtctgagatcttcacaggcacaggatgggacaggatggggccatgagtggtttagaaaaaggcaactttcaagcaggaaaacagggatataagttgtcactttgggccatggtttaaggcttttcagcttgaaggtggggttttgtcagagacctatccttttctgcctagaatttccctgtcccctgtccctatcagaactttgttccatagaaggaatttcggataagacttttggaaagcttagcctagccatggatttgtaccatcaaatacctatgagttgggtgaattcctctcctcttgaggttccaagataaacttggggctcctggaactgttagaaagtgacatgctttacttaccacaggtcaggaaccctgtacagggactgtgtagataaggtatgaggccagttctcccaaggggcttttattggctccataagtcaagtttgattcctcaaagaagagcacaccattcaagtaaaagccttggtaaaatgaccaatttatcgtgtcctgttacaaatgacaacagattcttattgcacttacgcaaataactgtattgccataagttaagaatactcacagatagtttccaattctggggaaaatcaggtagagagaaacaaatatgctccaaatatttttcacaggagtatactaacttgttaaaagctgacaacagctcaaaagaaaagtttccttgactgaaaaaaacaaaataaagggtcagcaatgttttaagcgaaaagtcaaaaagattacttcagtcttctgttagttcagttcatgcagttaattcctgttctgcttgctattcatgaacatttcaggtctccatgagtcctgaaagcttttccttcattgtgatgtcacaatctccagagttattagaaacctgcattcaagaatacctgttagagttttatagctgattataaaaccatcttctaaagaggactaaaacaagacaaaaattgtccatgggtgacaaaaagttttaggtcagccataggcgaaaacacaattgacaagaaaatttgttaccaccatggcacaaaataatttaatataacaatcataattattactgataatgtacaccaggtcatatcagaattataggagtttcccataattttggtgcacataccaataacaattttatacaaatacagcccaaataaaaccaaacaccattttatatttgacaatgcttcctgtataatttttataccaaataagtcaaattatttcatttttggacttgagggaaactaatatcttaaaggattaattaggtcagaaaaatacacaacttgtaatttgattttggaaagtttgtcaaatatcaaaggtttaaaacacttgatatgacaggtcatcataaaataagtcaatttttcaaacaataagcccaaataaaacagcataaagccaattaaatttgtttttcaaaattttttaaacaatctataacattttaatcttgaccataagatacaactttcataagccttttataacctttataacctttattaaggggtcagttaacacttcaagaaaaccttgttaatctgacacaggggcccatatgctggtattgcatcagtgtgcctttgacatcaattattaacttgtatagaaactgaacttattttatctctcaaaatcagcccttataatctcacatgcctacctcttctgtgatagttcctgagccttgaagagctgaatagctttgatttatggccttacgtctcagaaatgcagcttattttgataggcatcttctaccagtcctgaagatgaggttttaattgctgtcagtgtttaagatttagcagatcttggtctcctttttagatccaggagttaaaggccggtaactcaatgtcacaggtactttcaaagtgcacacagaaatatacatggatgtaataacgttaattttttaaaaaaattgtctcagtttctttttcctaagcaaaccaaaaattaataataatggcataggaattgtttcaataagccataaaatctgttaggccaattaccaaaaggcaaaagaaaagaccttctacactgcacagagtattactttggaagaaaacatttcctttagacttttagaaaacattgttagcatcaggccacaacaaacggaacttaaggaaaataacttatatgagctgaaaacaagttgaaggggagagaaaacagcaagtaaatagttgaactttgggttaaaaaattaaaatctcttataatttattaagagtaaatcaatcccttaagaaaatttcatcgctgtaactaattatttagtctataagtgttttttttagcatgaagcccaatcttcaggaagaccattataatttccctttaattatagacaactcaatcatataaaagttttttggtatttttttaaaataaatcctcttattatgacttatagagactgttcatgatatgcttggactatctagtttgttttgaacatccatctttcttaaacaatcagtcattttattttaggtctaaatttaccatacaagattctttctcatatgaaattatttctctttaagctttcttaccagcacaggctgaacagactttgagaggaaaatagtttatagtttacctttgaaacaaagattataatatttcattcccaaagtaaatattactgcctgtggactagaccactaaaagccacaagattcgaagttatggtaatctgactaaattcaagatgtggctatttttattaaaccagtatcaatgtcttatttattaaggattacacaagcaaagatcattctatcacagttttgtaaccccatgccaaattttgacaccttatagtatttgacagggataaacatgaaattgcttgattaataaatgcaaacaaaatgcatgctggcaattcttaagacatgtctaatattactttaccaatcattttaaaagtagcttatttattaaagattttacttaagttacataaacttgagaaagcattcaactagtcttttcttttttcctaataagtatttgatttaagtgctttttttcttaagccaattaattagagctcttttatatattttcagtagtgagacattgtgtacacaacacataaatacatagacctagtaggcatgttgatagaagtacatcttatagattcataagaagatttttccactatcttagactttcaaattctcaataacctgttttaatcccctaggaagttgtcagctaaatggctttaagtttgcatattaaaggaaacaactcaggcaaaaatcaaagagcaaaatttatgtcttaaggtacagagagaaaaagtctggtggtgctagagggaaattaaaatggacttcattgccaaataaacataaaattataaaaattataaaggccatttaaatacacacacacacacacacacacacacacacacacacacacatcctatagcttttacttcagaactttagccatgagacaaatacaaattcaccagcttgcaagcaaaaaaactgttgtatccaaacagtggttttgatcttaatagaaaaataacagcagatttaaagcaggcagaaaagaaaatagagaaaaaagagaacttaggaactctgtagtttgtaggtcgaccttaaggctcttcttttctttctttctttctttctttctttctttctttctttctttctttctttctttctttctttctttctctttcttgctttcttgctttctttccttcttttctttctcttctaaaaaaaaatgaaatatacatgcaggagaacgtgcaggtttgttacataggtatatgtgtgccttggtggtttgctgcacctattgacccatcctctaagttccctcctctcattccccaccccctaagagcccctgatatgtgttgctctcctctctgtgtccatgtgttctcaaagttcaactcccatatgtgagtgagaacatgttgtatttggtattctgtttctgtgttagtttgctgaggatgatggtttccagcttcatccatgtccctacaaaggacatgatctcactccgttttatggctgcatcgtattccatggtgtatatgtaccacattttctttatcaagtctataattgatgggcgtttgggttagttccatgactttgctcttgtaaatagtgctgcaataaacatacatgtgcctgtgtctttacagtagaatgatttgtattcctttgggtatataacaagtaatgggattgctggatcaaatggtatttctgattctagatccttgaggaatcaccatactatcttccacaatggttgaactaatttacatgggccctttctttcttaatgtaaatatgcacaaagaccatattacttccattttacttaaactctggcaagtacaggtgccataaaacctatggagtgcttgaaagggaatcattctctttgctttctcctcattcttagattatttgtttcccagttttcttcttaaaaagaggaactgagctgaggcctagaggttttctgtggtggatcaatatgtgccatttgtgggcaggactccacagtgggtcaccactgaaaacaacagttcagttcctcatgcaaatgcacacagacaagccgaatcgagcttaatttgtggagaaaaagcaacagagaggaccctttagaatgcatctctgaactagaattaggatctttaaacaacagcttcctggaaggaaaacaaaacaacagccaagaccactttttgtaaactgtgctcagacaccccttaactctgtagctgtcatctaccattatacccagcaaggtcaaagccaaagaggtcaggtcttgcaatacaggaaaatagaggtttagagttaagaagaatctacccatgactcttgaaactccacaaagaaaacaaaacaccccaaaaggggtgactggcgacctttgttctgattctttaagggggttcaagtcattagaagccttctctagattttttggtactgcggatggcaaagggggaaagaggtatatggtggaagaaaagtaaatgaaagaaaatttgttttctaaggcaggaagcaaacacagaaaccaagtgcacggatttttggttctttttgtttgttttcttcttttgcagctgcaatgaattttagccaaattaaagaggctttgttacccataattttgaattctcacttggatttgaccaagtcaggtagagttggtcaagtctgatgggagaaagaccaaaacaaacaacaaaatgtccaacaaaacgattaccaagcattctaatgataaggagaaattaagaccatctggttgttaaactttagccaagacaaagccccagttcagctacttacctagggatgggtctcaggctgaaagctgctttctaccatcctggaagcaggaaaaaaactcaaactggtgttccctgctgggagtgagctcaaactctacatgcgtttcatcatcatggaagcaggaaatcttgccttccttgtaaaggaagtaaaataaatcttgccttccttgtaaaggaaggcaagtaagccagtaaaactccaaaaaaaaaaaaaaaatagatggggaagttgtacagcaaaatacactttagatcttcaccaaattttgggagatcatggattctttggggagggtgcttccagaactcagtaaattgtcctcttggtttgagccataaggttagctcatgctattaccaggtaccaactggatatttgtcaaaggtcaggtgcatctccactcagaatcccttcagaattacaaaaatgtgaacgctgaatatctgagacaggcttcagttaatttagaaagtttattttgccaaggttgaggatgcttcagtgacacagcttcaggctgctccagtgacacagcttcaggaagtcctgacaacatgtgtgtaaggtggtcagataacacttttgttttatacattttcgggagatatgaggcatcaatcaacatatgtaagataaacacagatttggttcagaaaaggcaggacaactcgaagcaaagccgggacaactcaaagctgggagggggcttccagatcataggtatataagagacaaatggttgcattcttttgagtttctgattagtctttcccaaggagtcaatcagatatgcatttatctcggtgagcagaggggtgactttgaatagaatgagaggcaagtttgtcctaagcagttccgagtttgccttttccctttagcttagtgatttgggggccccaatatttattttactttcacagccttctaaccttatttatcctgcctcatgtttaaggaggcatcataactctatgattaagacctgggcaacaattttcttaaggcatctgaaaaaatgtgaagcttatcaatgatatctgaacaaatcatcttaaacttgattggctcaatagcttagggcacttcagagctgataattgtcaagtaaaagtaaaaacatcaagagcaggtgctcctactagaatgccaagttataatcacttaccatattctttcagattcaaatgaaggcactactcttggagattctaattaggatatgcaccccagctgcgacctactcaaggctatgaactaatttcaaaaaaaaattcttttttttctcaatttatttatttatttatttatttttatgatactttaagttttagggtacatgtgcacaacatgcaggttagttacacatatacatgtgccatgttggtgtgctgcacccatcaacttgtcatttaacattaggtatatctcctaatggtatccttccccctccccccacccccacaacaggccccggtgtgtgatgtttcccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcatcattttatatggctgcatagtattccatggtgtatatgtgccacattttcttaatccagtctatgattgttggacatttggcttggttccaagtctttgctattgtgaatagtgccgcaataaacatacatgtgcatgtgtctttacagcagcatggtttataatcctttgggtatatacccagtaatggattgctgggtcaaatggtatttctagttcaagatccctgaggaatcgccacactgtcttccacaatggttgagctagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatatgtcttttggctgcataaatgtcttcttttgagaagtgtctgttcatatcctttgcccactttttgatggggctgtttgttttttggtctttgacaaacctgacaaaaacaagaaatggagaaaggatcccctatttaataaatggtgctgtgaaaactggctagtcatatgtagaaagctgaaactggatcccttccttacactttatacaaaaattaattcaggatggattaaagacttacatattagacctaaaaccttaaaaaccctagaataaaacctaggcaataccattcaggacataggcatgggcatggacttcatgtctaaaacaccaaaagcaatggcaacaaaagccaaaattgacaaatgggatctaattaaactaaagagcttctgcacagcaaaagaaactaccatcagggtgaacaagcaacctacagaatgggagaaaatttttgcaatctactcatctgacaaagggctaatattgagaatctacaatgaactcaaacaaatctacaagaaaataattcttaaaaagaaaagtgagccttgaaattttcagcctttctgggtttatatatattaaaatgttaagtgtggagatgtttaaattataacgtaaacccatagagaccactgtcagaaatataccatgctatccagataaaatacagctcaacatgcttttttttctcagcagaactcactgggaaataaagcccgctttttggttataaattccaaaatgttgtttattgagtgaaatgactcgagtacattaaattctttatagaagatttcccttatttcattggtgtctacttttctgaaatttggttttatgttttttgtcaaaatagggacaatagtattgtgagatataatgtgttcatgataaaatgtgtttcaagagctaaggcatgaattaaatgtcttaatttagaatattaagacacatgtgcacatacacacacatatacacacagcacttttattccaataccttaaattatctatatttgatatagaatgtatcttcaaaatgatttcaacacgggttgctcctcctgtgtctttgtgtaaaatataattgccagggaatcagtaaaataattatgaaagcaatagagaatgataccaatgaattcttaagtgcagaaaagtttattagaaagcagagatgcaacaaagcataagaaattcaccctaggagaaacacagaatacaattgggtggctggatctgagggtgcaacatcagtgacaaaactggtcctgcagataatatctacctcactgagaaggagaatctgtaccttaaagtgataaagaaaataaggaaatcagaagattggaataatttcttagctagtgtattacaaattaattcacatttggtgccaccaccagaagaaaaagaaagcaagggagggagtttaaaatgaaccagaatgttctcacagagtcagtgaaatggtggtgggctctttggaagcataaggtccatcctattgaatgacatcaaccccacttcatgtatcctaatggtcagcacagtagaagggtctacatctgtgggccagtggtgaagggggacgtgagccagggcagtgggctcagcagcaagaggaggcacagcacaaggggcggggacaggtggagatgacacaggttgggcgatagcaagtggtgtggcaggagactcggccacagactggacgcaggcagcagcaggggcggcagcagcatgggcggcagcagctggattcacagcaagaggggcggcagcagctggagatgcagcagctgggacggcagcaggttggctggcagcacacagactggcagcactggggcctgcagcacctggacacacagcagctggggcgacagcagctggagatgcagcagctggggtggcagcaggtgggctggcagcacacagactggcagcactggggcttgcagcagctggacatacagcagctggggcggcagcagctggagatgcagcacctagggtggcagcaggtcgtctcacagcagctggggcgacagcaggtgggttggcagcacacagactggcagcactggggcctgcagcagctggacacacaacagctggggcggtagcaggtggtcctgcaacaggtggtctgacagcagctggggcggcagcaggtctcctgacagaggacttggccgcagccctggtcagagcacacggagccacaacaggagctgaccatggtgtcagaacggggaggatctgggtgggttttcaagagagtgaagttcttgggtttggaagtcttctgggtccatagcctcctttataccctgctgaaggcccattgccaccacgtcattatttccttattatttacctcgtggaaaacttaatcatgtaattacataattgtgtgcttctacttaaatactccaaaagagagaaaataacccatttccttttcctgctgtgctcctgtgtttctattggaaacacttgtcatatttcttccttagtgggggtcacctttgtccctggtctctgcagtgtcttttacaaagcactggtcacatgactctgacactttatttctaaatgtgattctccctcctacctgtagattgctctctgcaaatcatgggggacaatttttataatgtgaatgtgtcttttgttgtcaaataatgtcctggtcagatgaaatgttggaaaggaattagaaggaaggactcattcgggagaaggatgtcccatctataatgaagatgactctgattccgtgtatgcttcttgaatggttggggagatggtcagatctcaaggaagttataaactctgtgtcagatctcattccaccactccaagtgaaagtacttagccatgactcattgcctttaatgagtaaaaacacatttttctgtatgtcttacagcataggcatttggagtaggaagttttgatttacctttgatcatcaaaactgcatgatggattttcattgacaaaagcatttgttatatgtaaacaatatttagaattattaagccttcaataatatgcatccaagacattctattgggtactctgggtatagaacagataaaccctcctctttttcctgcaggtacttgtataagacacatgcataagaaacagaatttggcaaaaatgaaaagaattacaattatgttcattaaacaactaaaataaaaatgtatagtatgtggatcagttccatacatcctcagggtatgtatattacttgtgaagtattgactatgtaccagacattgtgctaaatatctttttcattttcactctttattacaaccttataaagtagtgtacattcttattgctcttttagcagaatactcaaaagaagcattaaaaagctaaaacaaacaaacaaaatgcttgtccaagattaaagagaaagtaagtctaatatgtcttagtgtagccaagaaagtggtaaagaacaaaatttgctaagcttgctgaaactgcttcatcttcttggaatgtgtcgtctttttttgtccactctgcaaactcctactcatttgtcaaaacccagttaaatatttcctcctcagtaatatctttcctgataaactaccccattcatttatcattatttcctgccttgtgctcataatgtgatacattctactgtatcatagacgtttacttctttcattcccccatatgcaatgcaaatagcctgaaggcatgggctatgacttttctttttgttaccatgatactcagcacagagaacaccggaaataaatgtttgttgaatgaatgaaggctttttgatgacatagaagcatgtaaggtcctttaaaaatgtatatatcgtttgacttctggataaaagagaggaaaacattccaaacaaggagatcagagtttcatttcaggaaaactacaattatttatgtggtaagcaacatgtcccctgataaatagcatatgtggaaccttgtggaattaggattccgtttatagaatgagacttggttatagataaccaggaataccatgttatcccattgtggaagggagagagggtgagacagagaaagaaggagtcaaactcatccttttataaggaacccactcttgtaataacaacattaatccactcatgagggtggtgtcaccatgacccaaacatctcctgttaggccccacctcccaacactgctgcattgaggatcaagtttccaacacatgaactttgagggacacattcataccattgcattccacccttggtcccccaaatccatgtccttctcatacacaaaatatattccttttatcccaatagtcccaaagtcatgttccatcaccaacttaaaagtcaaaatgtaaatctaagagtctcaggtgactctgatatgaatgagactcaacacaggacttatcctgaggcaaattctcctccatatgtgagcctattaaagaagttatctagttccaaaatccaatggtgggagaggcataggatagacaggcccattccaaaagggagcaacaggaaagaaaaaagggtaactggccccaggtgagtccaacagggaagacagcattaaatcttaagactggagaataaacttcgactccatgtgctgtctcctggatgtgcccgacatggggaagggctgcctggggccttggtgttaggccccaaatgccctcagatagccctgccccatggctttgctgggctcagcccatacagcagctatctgattggagtctctgctgcagctctctcaggctagtattgcaggctgatagttctacagttctagggtctcagtggctgctctgaccccccgttttcctgagcatggccctaggaggacctttctgctgtggctacaaccctaaggcaggctgtcagaaacatcctttcaaacctaggtggaccaccattgccccacaactcctgcagtctgtgtatctacagtcagtactacatgaacaccaccaaggctcacagtttgtggcctctgcagcagcagcacaagtctcatctaagcccacttgagccacaactggagcagcaaaggggcactgtgttagaatgtggagagtaccaagccctttctgacctgaagattctctcatttggagcctgtgatgggagggatagcttcaacgatctctgaaatgccttcagagccattctcccattgatctgatgaacagcacctagcttccttctattcttatcaatccttgtatcaaagcatcacttggccacacccttgcatgctttttcattctttttttaaaattttattattattatactttaagttttagggaacatgtgcacaacgtgcaggtttgttacatatgtatacatgtgccatgttcgtgtgctgcacccattaactcgtcatttacattaggtatatctcctaatggtaaccctcccccctccccccaccccacaacagtccctggtgtgtgatgttccccttcctgtgaccacgtgttctcattgttggtcaggtggcacattttctacatctatattctctgtttcccttttaattgcgaattccacctttaaatcgtttctttcctcttgcattttactatacgcagttcaaagacaccaatcagctccttcaacatttttcttggaaatttcttcccccgatatacttgttcatctttctttaactctgccttccgtaaagtctttagacatgaacataattcaatcaagtcctttgccactttgtaacaaggatggcctttactccagtttccaattcttgttcctcatttccatctgagatctcatcagaatagcctctattgtccatatttctctcagcattctggccacgaccacctaaataacctataagaagattcatactttccctacagctattattttcttctgagccctgaccagaatcacccttaatgctctcttcatagcattacagtattccttccctatctgtggatttactttccatggtttcagttacttatggtcaaccacggttctaatgtattaatggaagattccagaaataaacaatttgtaagttttaaattgcatgccattctgagttgtatgatgaaatatcaccaatcctgctctgtcttgcctgggacaaatgtcctccctgtgtccatactgtatacatgaccaccctttaatccccgagtaattatctcagttaccagactgactgttgtagtactgtaggatatgcagtgcttgctttcaaataaccctcattttacttaatgatggccccaaagtgcaggctacactaatttggttgacttggactttagaaaataatgtcacttaatgctattccaccataaaatcataataaaatcatgtattttgcagcaacatggatggaactggagatcattatcttaaatgaaacaaatcagacacagaaagacaaatatcgcatattctcacacatgggggctacataatgtgtgcacatggacatagagagtagaatgatagaccatggacactcagaaagcttagagagtgagagtggggttgacaatgagaaattacttaatgggtacagtttatgttactcatgtgatgatggcctaaaagctctgacttgctaattatgcaatctatgcatgcaacaaagtcacacttgtacctcaaaacttaaaaaatgaaataaaataataatgtcatttagcttcttcccaatacatttaaacataattaagcatcatagctaaagaatgcttctaagtgatgaggttcaaggctcaagtacagaataatatgattcacttgcaattagcacaaagtacattcacgctaggttaaatatatcttctgtaattacatttaccttcccaatttgtccatgaattttgtggaagatgccaattttccctcggtacaggccagggaaaattagcctgcacatgtcccaaattaataagattttgttgtatgatgatcaattatagcaagaaatttaggaagcgtaggagatattcaggacattgtcctaattcttttctatgatgtaacctgatcatcagaatttcaggtaatatgttagtcaagtaatgaattattgccccaacatacaatactcctaggaatacataatgccaatagaatagaatagagcaaaagtgaatcactaatgccacagtcttcaatgttcagaatattcacagggtcatgtagggatcggcttagggccttgaagagccctgtgtgactcacaggtgggatcacaatagcaggtccatgtgtgcagatgagctttatattggtcagaaatgttcttttggaaggtctttgttgggtttgatataatcggaaattaggagtcctatacagctatagatcatcattcacttatctattcaacaatggtgagaactctctcattctgttctacagactgtgcaggaacctccattctacttgttctttaagacttaggtgctattacctccacaagcaaacctttcctgatgctctctgcccaagccacctctcccttaagttgccctcttctaagatcctggcagcatgtttctcatgtgtttcatattgttgaatttattgttagctttttgaaagctttttggagatataattgacaagtaaaaattgcatatattcaaggtgtacaaaataatgttttgatatacatatacattgtgaagtagatgaccacaatcaaactaattaacatatcaatcacctcacatagttattctttttgtggtgaaaatacttatgttctagcaaatttcaagtgtacaatacagtattgttaactatagtcacattgccatacattcaatttccagaacttactgattttggatagctgaaactttatactctttgaccaacgtctaccagtttcttcctcattccaccccatgcaaccaccatataagtcagatcatgcagtatcggtctttgtgtgtctagcttatttcacttagcttaatgtcctctgggttcatccatgttgttataaatgacaggattttcttccttttaaaggctgaattgcattttgaataatgacatttatatacattttctttatccactcatctgtggatgggcatatagatatttctgtatcttagtagctgtgaataatgctgcaatgtacatacaagtgcagatatcttcaagatagtgattttatttactttggatatgtatccagaagtggaattgctggttcacaggtgagttctatttttaattttttgaggagcctccatactgttttccataatggctgcatcaagttacattcccaccaacaatgtataagagttccctttacaccacatccttgccaacacttatcttttgactttttgataacagccatcctaacaggcatgaggtaatatcttattgtggttttcattatcacttccctgatgattagtgatgttgagcaccttttcaaagactacatttgacagtaatttagaattctcaggtcaattgggaagttggaacacaaagggagaggaagaatggtggctgttggatagagagggatgtaagagctaaattctcatcacacataacagtgggccaatagataatatctaaactttaaaagtcaagaaatagtactgtaaccacaccatttagaaagatcttttttcctagagttctccctccaaaatcttcatcttactgttctcctctgcactgattgctttctaggcttgctgtacggttgccatttttggatttaccttgaatgcaattctgattttctgacttgaaattcctgttttctgaatctgtgttctcctctttgtcaacttcttcttcatgttggtggtgcacatcctccagacgttactttagaaagggttcacggacaataaggatttttttgggcttttcatatctgaaaatgttactattcctttgtttctgtttggtagtttggccaggcatggaattctaggctaaaaaacatcccactgagaaattttaaggcatttcccattgtcttctggcttccggtgttgatgttgaaaagtgtgatgccatttcgcctcctgaaccttggtatgggaaccacatattattttcctcattggacgcttttagtaccattttcatatccctaatattctgagatttcacagtgatgtatcttgatgtaagccttacattcactgttctcagcgctggtggtcttttaatctggagctcccttctgaaagaaattttcttatactatttctttgatagttttctcccttgtatttccttccttccttcttctttccttccctccctcccttcctctttctctatttccctttcttcctgtcttccttcctttctttttcttccttgtctttctttcttttccttccttcctctttctctttctttctctcctttccttcctccctctcttctttccttccttcctccctccttccttcccttcttccttccttcccttcttccttccttcccttcttccttccttctcttccttccttcccttcttccttccttcccttcttcctttcttcctttctttctttctttctttctttctttctttttctttctttctttcttttctttctctttctctctctctctttctctctctctttctttctttctcccttcccttcctgtcttcttttttccttttgagacaagacttctctatgttgcccaggctggcttcaaatccctgggcccaagggaccctctcacctcagcctcccaagtaactgggactataggcacaggcaaccattacacctgactccttatgttttctcatttgtctttctaaaatttttcttcattgagtggtagatctcctgaattgatcctctgtgttattatagtttctttaatgtccatttctttcacttctttttataattttttttacatatcttcaagacaggagaacaaattatttgactccttgttctactttaccttccaaacattttactgaacgtttttctaattttttctatcacattttaattctcaagctttcactcaacttctctgactgctcctgtttcttagaatcttgtttttatttcaaacagaatttcttctcttagctctcttgagtattttatttacaatagttcttgttttacaattttttagttctattctgctccctgtagtttctattcctgtcaaatttgtttttccccctttttctttttttctttttaaattagtgtgaattgtcaggctggagacatttcccaagtgtctgaagcatattggttaacatggcactaaaaagccaattgaaagttctgtgtggacagcagggcttgttaattgatctcttcacctctcctccccttcatccacaaaaaagaagtcaagatttatatgtttagtttctttagaggagaatcttccaatatcctgcttggaaagcttatggccatcagtcctggatgctgagcacagtgctcagattttcactgcatgagtctgttttctgttctattcttgacttttgttcactttagtattcccaaatctggagtctctgtcactaaattttctggaagataacccttgtttctcctggttggaagtgggggaggcctaatgaccaactttgtagggtggggtagggatccaggggtcgaagcatcctgctgcctaccctgccttcaggtgtattacctggtgactccgggttctgagcctttctgaggattcaaggaaaaccaactttacactctgtggtactctctctgtatgcattcacattgtagctccttttgttatctttagttgaccaccattgctcttgccccaaatttgctacactttcttatctgctattgtctcctgtcctgagaaagtaagatgagggtttctgttttttaacaccttttaaaagttggtgtatcataatggattcaaagaggataagaggacataaaagttaattttctgacattttaaggacctgctattactaaactgttaaaattagacttagtatctcatatatacactcccccttaagtgttcctgaagtaaactagtgcccatgctccagatgttggtgagattctttctctgtgtttccaaagcatgttaaataatcctgaaggttaattttattttccaatattttattcacgcctaaactgcattgaagggcaaaaaaaattgtggcatgcctgtggtcccagctacttgggaggctgaggtggcaggatggcttgagtccaggagttggagcttgcagtgagctgaaatggtgccaccacactccagcttaggtgacagaatcagaccctgttattttgatccacacaagctattggtcatgtgtgaaggcaatggaaagatttcctcatagattcaaggactcgggatatataacttccctttaaaattcctttaagaaatattcccattgactgaaatacaagtcaaaataaagaattccattacagtatagatgtcatgcataaaataatggttctgagagatgaagctgataaaatttaaaaagattcaaatatattctaaaagtggtaggggataaaaatagcaaagaatacacaagtggtaggcaaattaaaaaatggggtaacaatacctatattttctggtaataaagtgggtgtggtggcttgcacctgtaatcccagcactttgggagaccgaggtgggtggattgcttgagctcaggagttcaagaccaacctgggcaacatagtgagaccctgtctccacaaaaaatacaaaaattaactagacatggtggtgcatgcctgcggtcctagctacttgggaggctgaagtagctaggggaggttggcttgagccgtggagttgaattttgcagtgagctgacatggtgccactgcacaccaacttaggtgacagagccagatcctgtcttttaaaaaaaggaaaaaattcaaaaatgaagataacatatttataaatgtttatgtgccatagaagagatcatagaaatgaataaaacaaatacagttttgcaatatgcagatatgacagaataggcatcattactagtttgaggctctgatagatttctcaggcctaggtacttaagcaatactgaaacgagaaacagcttgtatagaccatttatggtcctggaataaattgaagagggatgcctgagcccaaagatacgattctcacgtcgcattaccatatcaatttctgaatatgttgttttgagttttgtgcttactttacttttttattttcctcttcagctaaaagttttgcctagagctcttgagcctactgatatcattttgattgatatcattttgaaatggaaggaaatggcttgaaaagacacaggaaatacaatatgaactgaactcccaatgcaaaagggaatctcaaagttataaaggaaacacaggtagctgggtgacttgatccaggtcatgtggagtgagccctaacctttgcatgtctcataggtagacctgcatgcaaattctgcaattggagctttaatggagcatgagtggatgaatatcattaatgggtcagtgaagcatctcaaaaatagaactcatctgcaattccaatttggtttccatcactttctttcccataatgacgtgtttcatcactcatgctcgctgattttcccactgactctatggcttcagcctaaaattatgcctcttatttttccatagaactcaccatgaattaatcttgacatatccctcctccttaaaaggactataattttttaaatgtctttttaataagactacccttcataaagatataaatattcggctgtgatctgattctccttcacataatcttacgtgtttgagacctgtgcatgttaacctgaattttcagaattgacacattttatttctatgaatcaatccttacgtatgtattacttttctccaatagaatagagtcctttttctcactaatattaccaacatactctccctgacatatgcatttaaattaaattcatgattaattgaattaattgagtggagagggaaaggaaagaaaaataactttcagaccacgtgtggtggctcaagcctgtaataccagcactttaggaggccgaggcaggtggatcacctcagttcaggagttcaagaccagcctgatgaacatgaagaaaccccgtctctactaaaaatacaaaattagccgggcatggtggttcatgcctgtaatcccagctacttgggaggctgaggcaagagaatcacttgaacccgagaggcagaggttgccatgagctgagatcatgccactgcactccagcctgggaaacaagagcgaaaccccatctcaaaaaaaaaaaaaaaaatccatgattatgttgtgagttacctaagggaaaagaagtgggtctcattcattttatgcaattcccagagcccaatagcttgctaatttgttcttaatttaattacagtaaaaattgagttcttgttttgtctcaataaacttgatggcaggtaaagtgagcaatctgttttggattaaaaaatgaattatttggcattttctctaatacaggctttggctgatacatataatatcaatttttttgttattgcccatacaataggaactcaaaccattttacaaataaataatcaacagtaagaaatactgaaaggtcacaaatgtttttgataccaagagagtgtttattgagatatagttactctaccagacgtaattcattgcaaagtccagaccacactcggcaattgtaagcttagaagcctgttccaatgaaatagtgtgagatatctggtcatctgactgcacaccaagcatagaagttggaggttttgtacgatatgcatttaaatttttgcttttaaaatagttgcttggtggaatgaacaatgagctatataaatgtagtggtggatcagggcaaggccaggtccagtggagaaggggaatgagaatgactggtacactgacaacaaggtggttgaaccagggctggtggtcaggaatgaagttcaacagcaagaggattcataggagactggaccacagcaggtggtctggtagcagactggacagcagcagctggacacacagcagccagggtggcagcagctagaagtgcagcagaagggtggcagcaggagggctggtagtactggggattataacagctgggcctggagcaggtggacacactgcagcttgagtggcagcagctagaaatgcagcagctggggcagcacagggactggcagcacgggggcctgcaacagctggacacagagcagctgggatggtagcagatggttctgcagtaggtggtctggcagcaactgcagcagcagcaggtctggcagaggccttggccacagctctattcagagcagacagagctacaacagaagctgaccatggtgtcagatgagaatcgcagatgacgagcagaaggaggcacttcttcctgtacaatgtgtctccatgtggttcaaggaagtagccacactcaccaagcaacaagataaatggtctttgacccacacaagattcaccggaaatactgatatcctttcaagtcactaagtctttggtctttcccgccttgtaaaaaagcttggctctttatgccgtacttcacagagccctactcctgattcatcttcttgagaatacaaagtcgcagttatatttgaatttaggccacagtcttatggatggaattgcacccagcaaggagttgatgagaaggtcatggccttggactcttcttggcatcttcctagaacatctcaggcagttttgtttttaataaatatagatttctaggcaatgctcttggatatgctgtgtcacttgattattatcctgagtagctgggattacaggcacctgccaccatggccagctaatttttgtatctttagtagagccaggatttaaccatgttggccaggctggtgttgaactcctgacctcaaatgatcagcccacctcggcctcccaaagtgctgggattacaggcatgagccaccactcccatcccaaaatagaatttctaatgaaatagacataatctaatttgatcttctagaagtcttttccaagcctcacacaaagattattaaaataattgattctctactttggtagattagattattccttattaatgtttactctcccccctcctcccacccaactccagaagtatcctctcccaccctctgacttggactttgccatgtgagttgctttgaccaatgagaaggcatgacccgaagactcaaaatgtgagattgttcccttgggcctttgttctcagaggaggatggcccctaaaataccggacactccattaaaatggaattccagacaaacaacaaataatttttaaatgtaagtatacccatgcataatcagatataattgtaataaaattatttgttgtttttctgaaattgacatgtaactggggaacctgtatttttatttgctaaatatgacaactctcattcaaaagaaagtcccaaaccaacctgtgggcagaagctaaggccaaccttaatcaaccaaaccccaactaacctacaaatatatgaccaataaataaatacttgttacaataagctatgagagtttgtggttgcttgctatgcagcaatagctgtctaattcaaccatggtagcaatgtgaagccagcttaatacaccaatcaatacacaaggatgaacagatggctttctacaaagaaaataaaaatagaacagtggccaagtatttgtgacagggttggttttatggtaaattttgataaattttctggaggggatagttagttaaatttttagctttatcaatataatgaggattaatggatagtgcaaagtgagcctattcaaattaattcaaaggagaatctcattttcataagcctatttgtgaaaacacagctttcgatttagacatgcttggatttgaatctagactgttatctaagagcctacagttcaatgctgttctggtcaggctatggcagaagctcaagctggaagagtgcttcacaaaggagcctcaggctcagcccgctgccctcccacagaggaatggcaggtgccagcccctttatactaggatgaaggccaaggtcccagaatcccaagggcctttgcccctatctgatggcttccgctacgccttgacttgtgcagacacctgcatggggctactgtaggtgtatcccagcaagtatgttacccagaaaaccaccataaaaagactggagttatatgtagcctgtggcgtccccactgatatcaacagtgcccagggctctcactttaccatatacaaagtgcaggaatcggtggaggccctggatatccattggcatttctacctgccatacaaccctatagcagcggggctgattgaatggatgaaacaaccattgaagaaacaactctggcaggagacgccctctctggctctgtggacacactgcttaccagcacccatctgcgccctgaatgaaactatccaaattagatgtatcactttgcaaaatcacatgccctggacgcttagtgtggatcttctgcattaattaaaactgaatgttgtgtatatatatccctgattactctcacaatgtaactcaggccgtgcaggcccaagatatccctgaattaacaggtgtgctctcatctccccagtgcacacactcttctggctcaaggacctgataccaccatcacgatccaggttgacagtgtaagggatggtacccccctcctttgcctcaacctgggactcaacctggggctatgcccttgccataggacctacccactggagagcacatcattacatgggcccggaaatcacaaaccagccccagttggtacagttttttcactccatggggcaagggcgtagaaaatgatatacagatcacacctattttacatcctattcctccttgtacttctaaaataatcaatcctagtccccacttgtgcaagggagtgatcatcctgtcattatgggacattacaatatccacactgtcttactgtggctgcaacgtgttgcagaagtgggcaatccatgtggtattgcaaaccaggcacaggttgctgctgggggtggtgatctctcagaacgacacaacttcctgtcttgttagatggcctgacttgccctttcttcttttttttttttttttttggagatggagttttgctcttgttgcccaggctagagtgcagtggcatgatctcagctcactgcaatctctgcctcctgggttcaagagattctcctgcctcagcctcccaagtagctgggattacaggcatgcaccaccacgcctgcctgatttttttgtatttttagtagagacagggtttcaccatgttggtcagctggtctcgaactccagacctcaggtgttccacacgccttggcctccaaaagtgttgggattacagacgtgagccactgtgcccggccaacttgcccattcttctacccactaggtatctcacctgtcacccataggtggtgtacctcttcaccaactgggtgcaaatggcgacctttccccaaaacaaaacagactgttgcatctgcagggagctgcccttctcctccagcatcagcctgccatggtgcatccaagcagctaacctcagtatctggagccatttctatacttggtataatgaccctcacccatttccctttagcaataaccacacttcatgtgataagtttcccaccatcagagatgagacaacatattttccacctagtataggagcaggttaatgtcacccccactgtggggtattctgtagatgatgggccagggtggacaacagcagtatagatacagcttgtgggctgtgcacccacatgtattaaaaggcatgataatagcatgccacaagctaaaaccagtagtatgggatggctacccccacagtgtaatgtaatctatttcttcaggtaatagacatggaatatgacagcaatgaaaccaatctcttcaggtaaccagtgatacttgactgcgacgacagagtgactctccacctgggggcctaccacaccccttaggatggctgtgggcatgcggcatccacagttggccttacttaccctataactggactggtagatgcacctggggacatcctcatttgctgggatacatcgtgcccagtttagacaccattcttactaactgggaaattgtaaaagccaggcactgctggaagcatgcatccctgtggttttacccgttggccacttttgccatgtccccccccccactccccccaccactcaccacccaagtggtgacaatagacatacagctgcaagttgaggccctggcttaacatagggctgcagtctttaatgatatctgccatgatattactcttctcactgaagaaactgcccaaattaggtgtgttactttgcaaaattgcatggcccaggacatcttaaccgcttatcagggcagaacctgtgcattaattaaaactgaattttgtgtatatatccctgattactctcacaatgtaacacaggccatgtgggccctagatacccagatttctgctatagaatctctatcttatgaccctgtaaccacatggtttaatcaactcctgagtgcttggaaaaactttctatacagtacaattgttgttacattcattattcttttttgttgtagtagtttatgttgctgctgaaacatctggttgcaatgctcctctgcatatcctagccccagggaaatctcagaagaatggtgtgattagaatgtaagggctattcaagggtatgctgaggtggagggtatggcagacacatctggcagcaataacttaacttaagcataccctgagaatgatcctacaatcaaagaagaatgtatgcttggagttctgagctaaggatctgggagtggccaacttggagatccactccttatctatgaaggacatttgaatccccacctcatccattagaacacaggtcatactggggattgaggccctttgttttggattaaatggaggttgttaggtggagggttctaatgaaaatactgtgtgaactgcatgctttttacaaataatagcagttctcctgtccagataccaccactggaccacccttgtatgtaagttccactaataaaccctgcatcatgttagctttctccaggtcccttctctagcctctcagacacattgtcatacttagtggagtcaatgggggtccaggatgacaatgtgtcatctgggcaaaacatttccctaattctcttccagtaccacttctaaccttgctgctgaaaggaaagttcattacttatttttttaaatctgtgtttaatatgtataaatgtaagaggttcaaatgcagcattgttacatggatatattgcatagtggcatgaagtctgggcttctactttaatatatgttttctttcctgtctaaagaccatggtttactgaatccaatgagcataaaactcatagtaggggctacttactgcagactgaggagacctggatctcagacctcatatggtgacctcattgtgtgaccttggtacactctcaggacctcagccgtagagtgagggcataggcctacatattctccgcaatcccttcccggactctacagatgcaacgactaattccaaacaaattacaaatataataattgcaatggatccttgaagagggttttacaatcaaggtagaagttgagtttggattggaaggatgaggagggcattccaggtgaatgatgacacatcaaaaccaaggcaggaaagcccaggtcctagtcaggggagagtgaccacaccagtggccagggatctgcatttcgtgtggtccctgctcatatgaaaaaccacaagcctatctttaagtgagtcatggaaggagctatctgtgaagcagatgactactggtctgcactaggatgatgcaattaacctgctaccatcatgcccatgtgcattaataaggcaagtcactgcttgggtgccggtgatgggagcctttgaagacaaggaataacatgctaattttagcgccaaagggcagagcgattagacactaatttagaaaacacattcttttctctcttatgggttaggaatatttcaaaggaaaattaatcagaagtgaatccaatgtctaaatttagtgaggataaacaatacaagaaaatgagcgaatatttgtggtgtatgtacatgaatatgtatgaggtgaagagtgaccaaaataccattagtcaatgctaaatcttcacttaattggccagaagatgcacaagaaaatgatcatatgttgaagggtcatcagctcccagccagggtatataaagggcccagagggggaggaggacattcacacctgagaacatccagctcctctcaatagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagaccccaatgcccccacagagcaatacactgaagcctaaacatctatctggtgtttttaaaaagttaaaagaaaaatagattttttttcacaaggtgacaatagtgatttttaccatctggatacagcctggtgtaagcagacgtccattaccaccctcacccacattttcaggtgtctacatcagccttagtcattatggatagtaaatcgacctttaagaattcctggggtggactttgcaaacacattctacaacctgatggtttttactgctcaaactgtcaccatcatcttttgcaatgtgttgctcactgttgtcaataaactaatttttcctggcatagcagactgccctgctccctgatttgttcgttagtgcatgtttattagcgtacacagataagcaagattttggaacctgcacaagggaaacaaagctcaacctaagcaaaaccttatccatagaaatctcatctattcagtcattcaggaattgtttatcaagggacctccagttgacaggtgctgcctgattagtgatgaacaagctacatgccttgtatccaagaagcttatggtctaatggaatagacaaaaggaaagacaatgttcatgaagaggggtagaagtgggaatagcatatgccaagcccagaatgaccactggtagtaaactgaccagcacagcgcatctcatcttcttaccacagttcctagagtagcatttttcaaagtgtggcccatgcgtcatacacaatagaatctcttgcaattgcctattaaaatgcacattcttaggccccaaaccaaacctaatgaatcaaaatctctgggagtggggcccaaggctgtttattttctatcacttccatgtaattcattagaatttcaggaccattatttcagaggaagaccaggatttgagctccttgagggcttaacaagcatggcctggaagccttccaagaatagtcacaaggacaagccacaatgaagacacccaaagtgaagaaaaaaatgtaatataataataagtatgaaacagcacctgctaaactgtaatcagaagaatcggtttggcagagaagtgaatgtaaatgaatgtgcaaaaaaacagtatcttgagtttgtcataggtggaataaaatgacaacaaaaaaagagagacaaaaagtaagagataagggatgaataaaaagtgaagaggggaggcaaggcaatgaataggaggaagagtgaagaggaagatgatggagatgatgagaaagacagaagaggaacagagacaggcactaggattcctggtacaagtatttggtatttgaagatgttacaggagagctaggccagtcctcagattacccatgtggctaggaagtgtgtgcacatcaggtggtctgctgcctgtcctttgcccatctctatagatccatgtctcactgctccccactaagattcacttcaagcaacactgaccttatagttattaaacatttgcagttccaaatgtttcgcttttcctcatgttctttcacttatctgttcttttacacactctttctcttcaccttcatcacctacttaactctgattcatttccaagattcaattcagtcttctccagtagtcctgtcccaacccctgtatcacacaaacacatgtgcaaatgcatacacacacacacacacacacacacacacatacaggttaggagctctcagcaagttccaatagcttacctccctccccataaggcattgtattgagattatatgtttttttgcctccaaggaggggaccacagtttgtttttggcttccaatactgagctcaaagtttaatacgtagccggtacttaatttctgtttgtttagttgtcaaaataaaaggaaattgtctttaccacaagaattttaaaaggtagataattatttaaagaaaaaattttggcattagtgtaacttaacctctctgactctcgagttttctcatccgcaaaatgggaaaagcaacatttaccaatgtagattgctagggaagttaaataacaattataactttttatgtatgcaagatgcctggcacatagttaaatgcccagtaacattcatttatattccttgtggagcatttggacatcactgtatcgaacaggctcaaaagatgtgctatctactacatatcaactcactgggaatgggaacaaattcaggggagggctttactaaccaaacttaaattgtaattttttttcaggatagtctacatctaccagtaggaatagattttctaataaatataatgaagaaggcaaaaaaaaaaacccacaacaacttggcatcagattaaggctgtctcagaatgaaaataatctttaaaaattcattctacaagtccacaggaatgagtcctagattataggatttatgaataggagtgcagcatcaggtaaaagaaggattgagcaacatgtaagtatctgatggttcgactctttctttcacattgaaccttccaagggaattaaacaactcaaagctgtaatagacctcaaaagattactttgccttccctgactttaggcaaatgaatatctaaaaaactcagatgaaatttttaaaaaaattctagcaacaaattccaccagtcccctgatcatttagtttttctgtctctcacaactaaactcttttcttttctaattatatctaattaattatatccctttctctgtcttccatgtttgtatggattttatgataagccagcctctgaagaacaccaggcaccgaagactctgcccattttacagatgaggaaacctggctaagggtaagtcatttactctaagttagacaactgcaaagaggtggagaaaggactggaatccttctttatcttctccattttcctcctgccctgtgcccgtcaatattccccatcccatccctgactcttatgattggaggatatttttaagattatttctgagaacgaagtccttaaggaatgtattttctaattttagaattttaataattttcctaacatctagtggcttccagactagttcctaacaaaatataattcataaaactattaagaagagggcatggcccaccatcacaagaggtcaccaacactacattctttatctatccaactacaaaaatctcacaagttattttcactgtgcttcagatttacttgtttccatcctggtgattatgcacttgaagaatgtgtggaacttgaataacatgactaaaaaagtccatgtggtaaagaccagggatacatctcttgtccaatagcttaggactattaatgtgctacagcaagggagaccacatggctgaggaccatggggcatcctcccaaacaaaggaggagaaatgttattataaaatgttgaggaatggtggggtaaaattacgtgacatagtgttttcataggctcaagaaaaacagggctgtgtataaaaaataattaacaccagacctgagctgtgaaacagacttatggtcctctttcactggaaactgtatagttgagacaaatggggaatgttgtgtctgcaagtcacttgtctgaaattctgtacctgggttgggtactgaggttgcttctctgtccagatgacttagatcctgtctaggcaagagtgaaatgtttccttcttactgatgtggcttggaagagcaaggtttctaacagcctataattttagaaaacagtatttcttagtactgtgttcttttgttaacaaaagcagtggatttacagacatatttctctttttagtttggcatctctgtatacattccaaaacaaagaacagaatgctaaaccatgtatcaagtgagtacttattttatttcactaaagggaataaaactttttaataactactgctacatgttatctattttgagtgactccgagttggaaaaagactgggagacatcaccagtgtttctactccacagaagacctgtggtattgctaaatatttgccactctttgatccgtacgactttggaggaattcattttgtaaatctggtcttccaaaaactgtgatggactatgatggatcatagactcaaaggacttcaaagatcagggatatgatagaccaaagggtgtatttttaaaaagagaaaacaaaacaaaacacacctcagaggtaaatttgcactgaagaccatcagcattccttggacaatgttatctttaatctaccttccaactctaaatttattttctgtattcctattcatctttgctatggctggaaaagacaaagctattttattggtcaccagctaaactaattccccttgtctttttcataatgccaccttcccacctcataaacaaacaaaaccctcagccaacaaactaaagaagctgtgacagaaagataattgattcctttgtagatattgtccatagatttttaagtatgtaatacaaagtgcatatgtcaaagcaagaaagcaagaaatagcccaatttcaattttatttctaggtcaataatcagggaagggcattcagaaaggcacagaatgaatgaaatccccatttagtttgaccttattgttcccagaaaagttctttccctttaattgcttgatttatctttgtcttgccttactaaaagttatgattactatgtgataggaaactatttgaaagctatttttctttcctttccccctccacccccaaatagtacagtaccatctacataataagtgtctcataagtgttaatgagttataaaccaactcagattactaaaataaaatcagtctagcagctttggtgatgattttcttataaacaaggttaggcactgtgtcattaaacactgggccattctttccatagcagaatcaatacacatctgctcttatgagccattttggtttttaagaaattcttgcttgatctcaatgccaatcagaaacccagcctgtgactcatgaacattccagtcccatgcttaagtcacggatggcagcgaacaagaggaaagtgtgatggtggctggattcttcaaacttgcaccttctcacatggcatggcctggaaggactagctgatagatgagcaattgttctgatgatatacatgaccaggtattccgttctagggaaaaagtagacaggtagaaaacaaagcattctttagtgatttagggatcgctgcctcagcagttaaatccagagttctcatttcaacgggcagctacaactccaggaaatgacctcatgtcctgggggtcatcagcatccagctaggatatataaagggcccagagtggaacgaggacattcacacctgagaacatccagctcctctcaacagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcctccctgcggccagccgaccccttgcagcaccacctgcaggacctcctcctgctgagaccccacctctcctctcaacgcacgaaacattcccaggtgcacagaagcttgtgcagactcttctaccccttctggatcagatgagagactccacctttgcagcctagctgatcctcaagcacgaattcaacaataacatcctatctatttccccacataattatgcagctaatcctggccctctctgacaatcttgagaaaaattccagctttcatcattcgaattcctggcttgaaaaaaaaaacgagtaaataaaaatcaaagctcctcttgaatagaactctgtcccactgactcatcacccttttttctactgtttcaaggttctcagatgagatttttttcttccaggataatactatttgtatgctgtatttttgcactgtaaaaaaaaataaaattatatttctggggaagcaaacatttctttttatttattgtttattgctcttcaaaagctcatatttagcttacattacagcatgcagaaccagaagaacgaaaggagagattttctaagggccatttttgagctttagaataggaacaactcaggtggaaggtctataattttaatagcatttcaaataaatctgatcatctcatgattcaccttcatatttcgagtcgcaggttttatggtgatgctgacgaaatggtgagactacagtaggtctctgtaaacataaacttgacttatgaataattcacacacatgataagggggaggaagtctaagctaagttatagccctatttgttcaccaatgtaggaaactgtacggtaattgatgtcaaacaagacctgggaatccctagccactgaacatcctatgctggaggaaccactatcccatcttctccatggttcccgtcagcaccaccatggccagttctacttccagtggagtggctgctgctgagaagacagggagaaatgaagccttggttgtaatcatcctagttttgagctccgcatacatcttaaccatttaaacaactgcaatgcggttgaaatgctgataacattaatccatactgcatatatttttgattttgttaaatacttgtatgttggtaaggaaggctaaccactatcattttcctgataaatatctttttagttcctagcatgtgatagaaaagagatttctttgattgttcagcatgtattcctgggcatatctacctgcccattgagagaagtgaggcaagggaagctttgtgagggcaggggtctttagtctttttaatttaaatttatttcaagttcaggggtacatgtgcacgtttgttatataggtaaattgtgtgtcacagggttttggtatacagattatttcatcacccaggtaataagcatagtaacagatggccaggtgcagtggctcaagcctgaaatcccagcactttgggaggctgagatgggtaggtcacttgaggccaggaattcaagaccatcctggccaacatggtgaaaccctgtctctactaaaaatacaaaaagtagctgggcatggtggcatgcgcctgtaatccaagctactcaggaggctgaatcaggagaatcgcttgaacctgggaggcagaggctttggtgagacaaggttgcgccactgcactcctgcctgggtgacagagtgagactctgtctcaaaacttaattaattaattaatttaattaaacaaaagcatagtaacagatagatggtttttttatcctcaccctcttcccaccatctgccctcaagtaagcttcagtatctgttgttcccttatttgtgtccatatgtactcaatgtttagctaccacttataagtgagaacatgccgtatttggttttctgtatctgtgttagtttgcttaggataatggcctccagcttcatccacattgctacaaaggacataatttccttttttatggctgtatagtattccatggtgtatgtgtaccacattttctttatccagtccacccttgatgggtatttaggttgattccatatctttgctactttgaacagtgctgcaataaacatatgcatgtatatgtctttatggtagaatgatttcaatccctctgggtccatacccactaatgggattgctgggttgaatggtaattctgttttaaatactttcagaaattgccaaactgctttccacaatggctgagctaatttacattgagggccaggatctcgactaactttgttcactactagattcccactgatctgcacgatatttggcacattgagtataatcagaaatgatgtgttgaatgataaatgagtaagttctaaggggattggttaaaacagagaaagacattatcattccatcccaactctcaactcatgctggatatgcatattcttaaaataaaacaataaaccaatcatgaagaaagatcttttttctggaaatatggtaaaagtttctcaacaagaagactgttatattcaaaaactttacatttgcagtacgtgcacaatggagttttatcttttttaacggtttggtaattaaccaatggataggctcacaagtctaatttctttctatatattcttgatcactgttttcaaaattcgttaagtacatctgtttttctcctctcagagtttttcttgttagccttctagagacctccttatttaaaagtgttttctcaaatggacaatgccttgtttcccctcaaacctatcattattattggatctcatttattcccacagtcaccccattctctggttggctgaagtggctggtgcagatctgggtaagcctataagaaaccatgcaagtggtgtgatcaataagaatgcttacacttgaaccttcaacttcagatctattaggctggtgcaaaaataattgtagcttctgccattgaaagtgccaaaaaccacaattactttttgcaccaacctaatagaacagtcttagttgtaaaggaaaaggtcagaaccaagtaaattaagaggcaaagactcaaaagtgattgagtgacataatttgcctacaagtcatgacagtttgaaacaattaaaaatgacaattggttccataagcagaaatgagccccagcatagcacacagggagatgttgaagacactgaggtatgggccagatgaggcccgagaacacgttcaagtgggatcactactgaagggttttgttataccgcaagactgcaaccttcctctacatagacttgtttgacttcctcaccatattggtggctttgttcacaataccccataatcattcagttatgcccaactatgacactatctccttagggtatgtttcgacattttcagaaggctgaatagaaggtaattcttcccactcctgaggctgttggtaagacatagagtcctttcaaccgactctaaaaattagacatatcataaataacaactgttttcaaagtaaatacactgtaaaagctcctaaataaaatagacattccttaatacctgggaatgtggtacctacaatccattctttagctacagtgagttcttcagctttttgggctgataaataatgttcccacagatatttctggaatgagtattggctccaacacttactaggtacatgaccttgggtaagtcacttatctggttccttatgtgtgaaatgagaaataaacaatatccacatcctaagaatgttatgaagattagattaatgcatgtattttttaatatgatgcttggaacatagttacaacttaatgatactggctatcatgaagattacagtgaaatttaccttggtctggaaagatacaaccatagaaatcaatgaacatatctctaagacaaaaaccactggatgatggaaacctactaaaatgcattcttgtacctccaaaaaggggacaggaaaattcttcttttactgagaaatcctgacttttaaactatccctgtagtattatcctcaacttgttttgcccaggaagcttagcagtggcaaagaatactaacaacttgagatgctcgctttacttcaactgctagcaagtaataaccctcagagcatgcagagcacaacagctgctttgagctatcaaaacagcaactagcaaaagcgtcattgaattataacgataattggagactttgaagttagggtcattaaattcatatttgaaccataaatagcaaaatataatgggtctacactaaataaggaaaatagacttttatgtgtacctgagcatctaaacaatgtctacaaaacttactaatctgctggtgttatttcaggaagaataagtgaaaacaaggaaatgaccttgtgtcctgggggtcatcagctcccagccagcgtatataaagggcccagagggggaggaggacattcacacctgagaacatccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagcccgttatcacgaagggcccctcagaagatggccaggtccatcccgctgcccctcagggcttcaccgcagagcaatacacgtttccttgagaagcccatttctcatctcttcatactagctcacactatgcattgaagacaccttttcagaccaaccacagatgagaaatacttttcctaggactccagtctaactcctatatcatgttgtctgctttctaataaactcaatactcctaccatagaaatcatggtctttgtgatattttcttctgggagattgtctctttttttctagagatactcaaagcaagatgcagaataatcctcttatacagttctcataacttaagtctgagtagttttcttataatcattgtaaatggcatttatggagcacagctgagtcaggaagatggatacaactatgactttatcatgtgtacagagtcacttgtgcccaaaattccaggcatgcattgaacacctgagaaatgttctgcaacaagaaacacgctaggaggccgcacctgggttgaaacttacattcccagcctaatggtgtgtttactgatccgacacctgttggaacatcatagaacgcccagggtgttagaggtggaagaagccttaggcaacctctggccaattacctctgtttttgaagttaaagaaacatgaataatgtaagagtaaataagttacttactaatgtaattataatcccaaaagttcagaaaagaccctggagaatacaagtttcctgcatttagacctcaggtcaaacacttcttagtatggtgagagacatgttaatcacaaaatggttgtacattctacaactttattttacatttcaatagccacacacacacatatacacacttcctaggaatacatctagccaaggaagtgaaaaatctctacagagaaaactacagaacacgacttaaagaaatgataggtgacacaaacgaatggaaaaacatcccatgccaatggattggaagaatcagtatcattaaaatgaccacactgcccaaagcaatctacagattcaatgctatttctatcaagctaccaatgtcatttttcacagaactagaaaaaaactattctgaaattcataaggaaccaaaaagagcccaaatagccaaagcaatcgtaaataaaaagaaaactgaaggcatcacattacctgacttcaaactatgctataagactacagtaaacaaaacagcatggtactggtacaaaaacagaaagttgtaaaatataaagtggcatagacaaaaggaacagaatagagaacccagaaataaagccatgctcatacaacaatctaatctttgatatcattaacaaaaataagcaatgaggataggactccctattcaataagtggtgctgggatagctggctagctttatgcagatgattgaaactagaccctgactttcaccatatagaaaaattaactcaagatggattaaagatttaaatgtaagacctcaaactttaaaaaccctaggagaaaatctagaaaacataattcttaacatcaaccttgggaaagaatttatgactaagtcctcaaaagcaattgcaacaaacacaaaaattggcaagtgggacctaattaaactaaagagcttctgcacagtaaatgaaactatgaacacagtaaatagacaacctacagaatgagagaaaatattcacaaactgtgcatccaacaaaggcctaacatccagaatctataaggaacttaaacaattgaacaagcaaaaacaaataatcccattaaaaagtgggcaaaggacttgaacaatcacttctcaaaacaagacatacaagcagccaaacacacatgtgaaaaaatgctccacatcattattcatcaaagaaatgcaaaatcaaaaccacaatgagataccatcttacaccagtcaaaatggctattattaaaaagctcagtaactgaagccccatactttcagaataaagaaaaaaatagttaaaaaacaacagatgctgacaaggctgttgagaggagagaatgcttatatgctgttgatgggaatgtaaattagttcagctactatggaaagcagtgtggagatttctcaggaacttaaagtagaactatcatttgacccagcaatccctttacttggtctgtagccaaaagaaaacaaatcattctaccaaaaagacacatgcacttgcatgtttgtcacagtacaattcacaatagcaaagacatggaatcgacctaggttcccatcagtggtggactggatagagaaaatatggtacacatacaccatggaatactactcacccataaaaaacaatgaactcatgtccttcacagtaacatggatgcagctgggggccattatcctaaacaaattaacccaggaacagaaaaccaaatgccatattttctcactgacaaatgggagttaaacatcgggtactcattgacataatgatggcaacaatagacactggggactactagagcaggcagagcgggagggagacaagggctgaaaaactgttgggtgctacactcagtcctgggtgacaggatcgatcataccccaaacctcagcatcacacagtatacccacataacaaactggcacatcacacaatataccacctgaatctaaaggaaaagttgaaataatgaaaaaaaaatttgttcataatgttattgttaaatgataatgtgaaataaagctctggagtttgttacacaaaatctgttgtccatcaccatgagaaatctgtctaaatcaatttgaaggcttttttttttaaggatgcttctctaagaccccattctgtattgcatgggctgtggggttctcagtaggggtcttgttgctatacacagtcctgacagatatgccttctgtcagttcaacaatagcctgactcccttcacagaggtaagtgctcaatgagaaggtgctctgtttcttccttccaggtgcttttattttatttcatgctattaatggaacttactactgaataatgttatttcatgtgtattgtttggtgactgagcagagaactaaccatttgccataacaaatatgttggtcttttttctaaacttaaagtttagaatttagaaagtaccaatgtaacatgaccttttgctatatatacatatggtatacatatagtaaatatatatagtatatgtaaaatacatatagtaaaatatatatacatatttgtatatatacatatatactatatatagtaaaatatatctagtatatctgtatatataaatatataatatattatattatatattttactatatataatatattatatatattttactatatataatatattatatatttactatatataatatattatatatattttactatacataatatattatatatttactatatataatatattatatatattttactatatataatatattatatattttactatatataatatattatatattttactatatatataatatattatatatattttaatatatatataatatattatatatattttactatatataatatattatatattttactatatataatatattatatatattttactatatataatatattatatatattttactatatataatatattatatatattttactatatataatatattatatatattttactatatatataatatattatatatattttactatatataatatgttatatatattttactatatatataatatattatatatattttactatatataatatattatatatattttactatatatattatattatatatattttactatatatataatatattatatatattttactatatatgtaatatattatatatattttactatatatgtaatatatatgtaccatattatcggggaacctgccccgataatcacgtatgttcttttctattttcctaagcatcggctggcttgagaaataaagggacagagaacaaaagagagaaactttaaagctgggtgtccgggggagacatcacattttggtaggatccgtgatgccccacaagccacaaaaaccagcaagtttttattagggagtttcaaaaggggagagagtatacgaataggtgtgagtgacagacatcaagtacttaacagggtaatgcaatatcacaaggcaagtggaggcagggcgagatcagaggaccacaggaccgaggtgaaattaaaattgctaatgaagttttgggcaccactgtcattgataacatcttatcaggagacagggttttgagatcaaccggtctgaccaaaagttattaggtgggaatttcctcttcctaataagcctgggagcgctatgggagactggagtttatttcacctctgcaatctcgaccataagagacaggtacaccccgggggggccagttcagagacctacccctaggtgcgcattctctttctcagggacgttccacgctgagaaaaagaattcagcgatgtttctcccatttgcttttgaaagaagagaaatatggctctgttctgcccggctcaccagcggtcagagtttaagattatctctcttattccctgaacaattgctgttattctgttcttttttcagggtgcccacatttcatattgctcaaacagacatgctgtacaatttttgtagttaatgcaattattacagggtcctggaatgatatacatcctcctcaactgacaggattaagagattaaagtaaagacaggcataggaaatcacaagggtattgattggggaagtgataagtgtccatgaaatctttacaatttatgtttagagatttcagtaaagacaggcataagaaattacaaaagtattaatttgaggaactaataaatgtccataaaatcttcacaatccacgttcttctgtcatggcttcagtcagtccctccgtttggggttcctgacttcccgcaacaccatatacatatatagtatacatacatatatactgtatacatatatactatacatattttactatatatgtaatacatatgtatatatacatatatactatatatattttactatatatatagtaaaaggtcatgttactatatatgtgtatatatgtgtgtatatatatatttactatatatatatatatttaacaaatacaagacactaagtgccagacattgtttgttcttagcacttgacaaatattagctcatgtaatccttacaattctgatatgaactattattatggcccaaggacacacagccagtaagtggcagagctttaaatgagcattgtccagtttcagaataagtggggtcagaaaataggatgtgacttgccaccaagtgtcaaaccgcagagctgtctgtgctcttacaactctgaggcatgaataactgaagcatgacccatattttctctgcctgaaaacgaagtttggctatggggtgtggataagtgtcttagagtgaataaacactagaaaggttactgagtgatgcacagattatctttttggacctttataaaggggagacagatccttataaaggggagagacagatctttataaaggggagagacagatctctttagaatgaccttgggtttgaagtttctgcagtagagaaatgagtcttgttaatgtgatgatttaagtcttccaaagaggctcccattgcataaaatgtgattatcatgaagactccacagcagcatgaaaataaattatgagataatatgtctcgaaaagagcagaatatacaactttttacctagttacctctggttaccactttgaaaaacaaaaatcccacgtccgtaaacaaagaaaagaatgtaaaacaggagagtcaaaggtctctagcgatgagattgtgcctgatatctccctcttctgtttccctaattgtgactaccgggtccagtcaatttacattcctcttaaagttttgaaattatgcttgaaattccatttggggagctttagatgtccggccccaaggcacattctttcaaataaagaaaatgatcccgaagtgattcaaaaccctgtctggtgactaacaggaggagtaaagctggaaagtaatgggactgtttcccccatgtagttcctgaactgcccctggcaacacttcctgaagaagcgcatccatcacgcttttagcagtgccacagcagaacactgggcagcctcccaatgcgtctacccctgaacagtgttctggatatgtgtgcaatgttggttgaaaacccctttcttgtcacttgctaatcagagcacctatgtcaaagtatatatgcatatttcttttttgagatggagtctcactctgtagcccaagctggagtgcaatggcatgatctcggctcactgcaacctccgcctttggggctcaagtgattctcgttccccagcctccggcacagctgggactacaggcactgccaccacacccagctaattttttgtattttattagagttgaggtttcaccatgttgcccagggtggtcttgaactcctgagctcaggtgatccacctgccttggcctccccaggtgttgggattacaggcatgagccactgcgcccggccaacaaggtatattcagaaaaatttcccattacagaattcttcattacatgcacaagaaaggcaacgctaaaaaatgacatgtttcagagataaaaatcagcatcttatgacagaaagaccagagttgcacagaacctgaactagagaaaagaaaacatgcaaggcagtcttggaggttttattccaacacttagtggtttgcaaaaatttttgtctgtcctgtacaactctatgagctgctatcctattcaaggcctatgtatcccactatatcaagtgataatcaaacgtattcccaagcagactacgtgggagggcttgtctaacactcgtgtgattcacgtttcacatgtaggtgcttccaaggacttgagtcccctattggggtcaggataggctctactcaatgttctatgtacttctctatgtttttaatttcttttaaaaactgaagtttttttagaccgttttgtccagatttgatccagtgttatctactcaaaataagcatcaagagctactatcacctcaaatgacgatgagttcttagattttcacccaatgtgagtacatccatacttagagataaaacaagagctctttagtgagataatgagtgtgtcacaagcaaccattagtcaaaacaaaattctacttaattggccaaaaggtaaacgaaaagggtcacctgcacccggccagggtatataaagggcccagagggggaggaggacattcacacctgagaacatccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagtgcactgactgcccggaacgcgtaactcaccttctgaaaaagtcacactcccatttctctactttaacaaacctcctgccctgagcccacaaaaccccacatcaaccaagcagggaaccgagcactgggctcatctattaagacctgggccattctgaagtctgtaaaagaagcaatttccttcttcttaagatttcgtggcatgtttattttctaataaatatctgttctttggccttgcaaaaagatttggttttatttactcattctaatattttgtattaaattaattttttaattaaaaaaactgacacataattgtacatatttatggggtgcaatgtaatgtttccatacatgtatacgttgtgtaataatcaagtcagggtgtttagcatattcgtcacctcatacatttatcatttcttcatggtaagatcatttaaaatattctctgatcgctattttgaaatatatgataaaatattactaaccacagtcaccctactgtacattagaataccaaaacttatccctcctatctacctgtaactttgtacctgtagaccaatctctgcctatcctcccctcctctcaccctccccagcctctggtagtcactattctactctctacttctatgagatcaacttctttagatttcacataggagtgagtgaatgtgctatttgtctttctgtgcctggttaatttcacttaacataatgtcccccaggttcatccatgttgctgcacatgacagtatttcattctttttcatggctgatagtatttcattgtgtgtttgggtgtgagtgtgtgtcacattttctttatccattcatccattgatgaacacttagattgttttcatatgttggctgttgtgaatcgtgctgcaataaacatggaagtgcagaaatctcctcaacatactgatttcatttcctttgcgtatatactcagtagtgggattcctggatcacatgatcgtcctatttttaatttttggggaaccctccatactgttttccataatggctatactactttacattccctctaaccttgtatgagttcccttttttccacatccacaccagcatttgttatctttttgtatttttgataatagccattctaattgtggtgatatggtatctcattgcggttttgatttgcatttcctgatgattagtgatgctgagcacttcttcatatatgtgttggaaatttgtatgttttcttttgtgaaatatctattcaggtcttttacctatttttaattggattttttattattattcactgttgagttgttcaagttccttatatattctagatattaacccctggtcagatgcatagtttgaaaatattttctcccaaatttttgcaatctactcatctgacaaagggctaatatccagaatctacaaagaactcaaacaaatttacaagaaaaaaacaaacaaccccatcaataagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagatacatgcacatgtatgtttattgcagcactattcacaatagcaaagacttggaaccaacccaaatgtccatcaatgatagattggattaagaaaatgtggcacatatacatggaatactatgcagccataaaaaatgatgagttcatgtcctttgtagggacatggatgaagctggaaaccatcattctcagcaaactatcacaaggacagaaaaccaaacaccgcatgttctcactcataggtgggaattgaacaatgagaacacttggacacaggagggggaacatcacacaccggggactgttgtgtggtggggggaggggggagggatagcattaggagatatacctaatgtaaatgatgagttaatgggtgcagcacaccaacatggcacacgtatacatatgtaacaaacctgcacgttgtgcacatgtaccctagaacttaaaagtataataaaaaaaaaagtaccaaaaaagaaaatattttctcccattctctaggctgtctcttcactctgctgatttgattgtttcctttgctgtgcagaaggttttaattttatataatcccatttgtttactttcacttttgttgcctgtgcctttgaggtcttatccccccaagaaaaaaccattgcccagacaagtgtcataaaatgtttcctgtgggttttcttctagttgttttattatatgtggtcttatatttaagtatttaatccattttgggttgtttttaaatgagttaagaaatagggtctaaatgtgctgcttgcctaccatatgcaagtcacaggctatatggtataaaatagaaagtaaaattgaattaaaaatgttcccatcttcaaaaagattctagagacatgagtcatattcacctataattcatctaaaaactagaatattaaaaaataaaagtacaacactgtgtggtgtcaacacagaagtcactgttggttggggaaaataagaaagattgaaaagagaagctaacattttatataggttcagattgtggtgtccagatcacagggatggcattctcagcaatagaaatagtatgagcaaaggtgtggagggaggggaaccatagggttgttcagagtacggtttggctgggggcactggatatatatagagtgataatgaaagaaagatttggaaaatttgtatgctttgaatactagccaacggagtacacccttaatgcaataagcagtaaggagttgttgaaagctttggggcaggaaaatggcataacaagagcagggcattgggacaattctcatgatagctccttataaagacagaggtcaaaggccagagaaatgagtcgtacagaactatacagaaactaatcaggaagatattgccttggtcaagtgattacaataagagctcaactaagataatacccatggaataaagaagacacaatgagtatagcagatgtagaaacccagaaagtatattaacttagttgaatgtgggaaacaaaaaacaactaggaggcaaatgtgacttattccaattataagtctctggtccagatacttaaaagaactttaacatatttgtacttatttattgtgtatttaaaatcactactccatagtgccatctctctaccatctaatatttctattcttgtgctattacaaaataccttttttttttagaaaaaaagacaaagacaaagagccttactaacattaattgattctgaaaagcagcatggtataaaataaaaagaactggtctaggaacaagtgataggaattttatacccagctcttctggttgtgtactgtgtgaatggaacaagccacttaacctcttcaagactcaagagtattctaacatcagccgatgttaagtgaaaatgaaaagtgctccatagcacatcaccaatgttcccatttagaactttgagactaaatggttctatactcaactcttttccttgattaatccctcctattgctactacactgatttttatactagagcaagatacaaaacaaatagatgggatcttgctttctgtataagcctttagtgctctgggcatagtagaagttaataaatatgtgctatttataataagaatgatgtcagtttctacacctataaaattaagtggtggaacaagataatttactacatttttgatctccaacattcattgattacatataaccattttcaacttcatacctacagtcatggttaccatatgacgtgaacatctttactgaagctggcatgaatcacattgtgatataaccccattcctgtacaaacaaatgccaccacctcataaaaagctaactatgtgtttctattcatgattggaagggagaaataaacctaccccaagtagaaataatatgtttttgaccagccttttttcatttatctcacgtaaccctaaactcccagtgaaaattacattctttcttctggcaatgaccaggaattgttttaacttttattttgctgaaatttttcttaatctctttgcatttattatactacacctcttgaactatatttggtcacccattttctaacctgccttataaagcagataaaagtattttctaactcttgctttttctttgatttattccctttcctaaattcagttgtcatgctctttggtctaatatcttttcacaggacacatggtttagtaacttgaaatgacataaattaaaattaaattctgcctttgaaaaattatatgccagataatccatatacaagtgatttttgtctttcatagagaagtgtaaattttgttaaaatattttgcaattttttccaattactgaatatgaattttagcctcttttttaagagacattgaaattgaacaggttttgttttatatatcctcctgagtgatcaatgtttcctaaaatatgaatgtgaagttcaggagatatcacagaaattggaaagattccatttcagggaaaaatctatgaatttctatgaatatagagtttatcagagtttctatctggctaataagattatatcgagagaggataatcttattagtctaaaaaatacaaagcagtcttacataagggcaatcatgattaataattcttttctggagacctgaggtttggtgaatatgatctccaaaatcacatcaccttatgggtgagagtcactttgtcaggtgatatacccacaagtgcaaacctgaagctgaagctcaagtggaaattataccattgtttgtaaacaaaatgttaacatttttaccaaggacaaacacatttggtgagtattagctgagcaataaggaaaaatcaattttgagatatatttaaaacaattcagcatttgaaccatcagagggccctagaaaggctggtttaaagagtaacaagataaaaatgttgctcgccacaaatagaggaattggcccagacttataaaaagccggcagtggaataggcagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatgatgaagttgttgtttgaactttctttgctttggaatttattaacaatattggggtactgggatttttcaaaatatcaacatgacatgacactatggtttttctgtacttttgctcttttaatgatgatatttaacagcaattttcctttgttttaccattaaatggtccaatattttgcagccaagacatatgattaaaggaacttgacaacatttaggaactgtttcctaaggtcctctcatgtgcaaagtggtgggctaggtattccaacagattgattcagcttcttgaggttttgccaaatctattcattcatccattcatatatgaggttgtatacaattatttctgtcctccaagatatacaaaagcataataaaaattgtgaaagaatacaaacacaagattacagagtaatagcatgtaacgaatatacacatttcattcaaggtctaggctcataactcccatagcccttttattgatgttagggcactttacacttcagaagcaggcctcagaaaacagaatctctctctctctcgctctcgctcactcacttgctcttgctctctctctctctctggccttctccccacctcttttcacctgctccttttactcctcaaggcaagaatcttcccccactgttcttggcactggccatcaagatattctcctacctaccttgcctgattgtaggtcataagatccccatttcagaagaggttctgccccatgccctggaggaaggaaggctgcatagagagaccaagaaggatctgacagacaggtttcatcactcactctactaacattagatcatactctttttgtccaatcacgtttctaatggttgtccatcatgcccatccactgaagtccccgtaaaatgttcaaaaaaaaaaaaaaaaaaaaacccacagagtttgaggagcttccagatagctgaatgtgtggaggttcctggaatgtgctgttcccagagaggttatgaaagctcctcataccccttcccccacacctcaccctatgcatctcttcttctgtgccatttgtaattgtctttataataaaccaataagctaaatgtttccctgagtcctgggacctgccctagcacattcatcaaacttgagggtgtcatggaattcccaatttatggctggttggtcagaagcacaggcaaaacaacctggagcttgtgcttggcactggaagtagggggcagtcttacagaactgagccctccccctgtaaaacctgacactatcaccaagtaaatagcgttagaatggaattggagtggaaaacatgcagctggtatctgctgcagaatttatttccttgcttcttgatggggagaaatccccacacattagccacagaaatcttctgtgttgattgttgttgagtgagagagtagaaagaacatttgagtgtgtttttttttccttctacccaatagcataagatgtaaaaatagcttatgctattgggtagaagaacaaaaagctaaatcaagactcctgagttctagtcccaactttgtaactagctatccatgaatccttgagcaagtcccttcacttgcctgggtacctatttctaatttgggaaatgagagaattgagtcattactgacaacatcccttccaggcataagagggtagataatttcctaaacaggctacacactgaccagtaatagcttcagatgcccaaagaggaaaaaatatacagtggtcaaattatgttgtatgctttatcacctttttgcaagtttataaagccacactggaatattaaagggactgagatggcctgcaataaataaagctctacaaccagtggccgggctcagtggctcacacctgtcatcctagcacttccggaggctgaggcaggtggatcacctgaggtcacaagttcgagaccagcatgacaaacatggcaaaaccccgtgtctactaaaaatacaaaaattagccaggcgtcatggcgggcacctgtggtcttacaggctgaagcaggagaatcacttgaatccaggaggtggaggttgcggtgaaacaagatcgcgccactacactacagcctgggtgacagagtgagagtccatctcaaaaaaaaaaaaaaagaaaaagaaaagaaaaaaaaaacaactctataaccatcactcccaaactaacttagccagaaaactctctatttttatgttacctgttaacaccctgtaacacaaatactcctcaaaatatactttgaaaaatgatgaaagggagtatcaactgatgtttttataatacctgtataatcttcttatgtattgtgaagcagaaaataaatgttcactgcaaggatggatttaaatactgtcactgttcttattctaattttcagagagagttctagatgaagcaagcattaaataaaagacgcatagtgaggctttcattccaagggataaaatcttttgtcattaaatcaaagtggtgagccagtgcctgggggtagaggggtatgggaagtgattgcttaaaggtcatgggggtgttcttctgcgatgatggaaaagtttttgaagctagagagagatgatgttgcccaatattataaatatactatatgtcactcaattatacactttaaaatggttaattgtaggttatgtgaatttaacctccattttaaaaaatcaaaagaacaggacctctgctagcacaactttaaaagaattaggaaaaggcaccactttggagaagatacagacagaggagtgcacagtttgttgagcctccagcttgatgtaagaaataatatgctccttcctctgagtggacagagccacacatcagggcgcgacctgtacatctatacacaatggccctacaatgtagtcaacattttattcccctcatttagagctctgttgtctctgagagggtttaggttggatgtaccttttaattaaaaggactttggctcagaagcaccccaaaaaatcctggttggcattcaggagggaagagatagatcttgtgacttggcttaggataaaagttggtagtaagaggaggtccttgaagtttatgtgttatctggtctagattactaggatggaagcccagagcagaagcacagaagccctacataggaatgttgtattcatttgactggtacatcaatcatgttttatttctcgagaatctaagtaaggcagtcacaaccgaattagagaactagtaaaacggagatgaagaaattgggagaatccccagaacttgtaactagaaaaccagaaccatgatatcttaaagaaaaataatttcaaacattagtgtctgtgttaaaccaaagccacgttcaggaataacagacaaacacattctttcttcttatggtactggaatggtctacagcccatcacttaaatgaagtaatgaatgccagagggaatcagcacagtaataagaaatgtggtatatacacacaacggaatactattgagtctataaaaagcaggaaattcggtcacatattacaacatacctaaacttgaaggatataatgtaaagtgaaataaaataaatttcattttcttaatttacttagaggaggtaagggaatgttcagattagtcttcgttctgtggcacaggagtcaaattctcaagtaagtgtcataccttaaattttgcattgaggaagatgttgaaaatagtgccacagtagaaaagcccagaaagggagaactgatatgcaacgccactgtctccagtgctcttatcaataatgtatttcaggtcctcagatatctgagccttttgcaaaaggagatacatctgtttagtatcaaagattctgctaaatttagatctgaattaaatagctcccgagattgttgtcatgacacacccacgtatttcaagcatccaacataaaaaatattagctaatcaaagaatctgtgatgtagctttgcttaagaagaagcaaggaattcacaaagaatcatatcttttaaaccaaatttgatgtgggatttgaaaatatgtcttaattctgactcagaaagagttatgatgtaaactcaaagctgtcatttctagagaagcagaactaccacttggtgttctggttcaaaatccaagagtagcatcgtaacttgcatttctcagtaatgaacccatactccatggaggcctggtcaccttttattgcatctaaacaaaacctttatattcaccgtcatcagctgtctcattcaaattatataaactttccagttcactggattagtctctaatatctataataaactgcatacagccgatctaacactctgtagtaaatcacatactccagtattaatatgttaaaaactataattttatgcagttaaaaaatctaaatctatagaatatcctaagataaaagatgagacaaagtcacaagaaggttaacttttttagcacttaagattttcttgaactgtgcttattatgctgttaataaataaataaaatctctaggaatggctgtagtaaactgtgttattacttaccctaagctctcccttccttccttttactctcaaaaaagtccgtaagaaaggaagcaaatttttacggcttgctttcaccattggaatttccttagaatgactttttacataaaaaaagaagaaaggaaagaaagaaaggagaaagaagaaaaagaaagaaagaaagaaagaaagaaagaaagaaagaaagaaagaaaggaaggaaggaaggaaggaaggaaggaaggaaggaaggaaagaaagaaagaaaggaaagaaagaaagaaagaaggaaagaaagaaagaaagaaagaaagaaagaaagaaagaaagaaagaagaaaggagggaaggaaggaaggaagggagaaagacagagagaaagagagaaagaattgactatagtgtttaaagagtttagtctggaatcagaggttgtggattcaaatttcagattcactagatactagtgtgaactagggtaagttacttcaacctgttgtggctcagttttctcacatggttgatgggagtggcagtgatacctagcccatagattgccgtgaaaattcagcaaattgatacatgcgaagtactcagaactatttaggcacataatcagtgatgggaaaatgttatcaatagcaattaatgcaaatctcccaggcccaagaaagcatccctttctggccagctgaatatagtcttgcttcacagtcaaagggaagataagaaagttagagaaggagccacagttaaaattggagggaattaaactgtcatgtgagacccaatcacccagttgtaagggtcaacactgagtaatattgacaatccttaaaggtgaggcatcagtcaattattccttgaccatgaggaaattttaagaaacatgaggagttagggatcatattcctaattaatgccaatgacttcttgaccatggtaaagaagcctaattgcagaccaaatacaatcaactttcaaaggctctcagtaggttcaacaaataattcagggagaggccaattatcattcagagacaaattatccaacacaaataagcaagagacttctggaattatgtaaacagtagctggcccaggcttataaaaggcccaatgtggcagccatcaccaaaactcagaaactcctccaagcaacccagacttcataccagctcccaacaccatgacctgctgccagaccagcttctgtggatatcccagctgctccaccagtgggacatgcggctccagctgctgccagccaagctgctgtgagaccagctgctgccagccaagctgctgccagaccagcttctgcggatttcctagcttctcaactagtgggacctgcagctccagttgctgccagccaagctgctgtgagaccagctgctgccagccaagctgctgccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgtgtggtgagctgcacacccccaacctgctgccagctgcaccacgccgaggcctcctgctgccgcccatcctactgtggacagtcctgctgccgcccagtctgctgctgctactcctgtgagcccacctgctaaaagccagtttgctgattttcaacttgaaatttccactttcagttccattcatgaacgaattatttcttcaagcacttatggacaacgaacaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgcaacaaacatatcttttttttttcattgagtgtactcaggatgtatatttcatagaatgtcatatgaaaaactttaatctgcttttgatatcccttctcttctaataccacattaggaaatttgttatccagaggtccagtggaggttaatgaccataaaaacatagagtaagtgtagttatttagggcctcagaaatggcaaaggctctgttaccataacttaaccttacacagtgctttcacaaccaggaagttacagaaatcaaaatctctggctgggtacggtggctcacacctgtaatcccagcattttgggaggccaaggtagacagatcacgaggtcgggagtttgagatcagcttggccaacatggtgaaaccccatctctactaaaaaaaataaattgcatttctatatactaaccatgaaaaatctgtaaggaaaattttaaaaacaattccatcaaaagaataaaatacttatggccgggcatggtggctcatgcctgtaatcccagcactttggtaagctgaggtgggcagatcacctgaggttaggagctcaagtccagcctggccaatatagtgaaaccctgtctctactaaaaatacaaaaattagccaggcatgttcgtggatgcctgtggtcccagctactggggaggctgaggcatgagaattgcttgaacccaggaggtggaggttacagtgagccaagattgtgccacttcactccagcctgggtgacagagtgagactccatttcaaataataataataataataaaataaagaataaaatacttaggaacaaacttagccttggaggggaaagactcgtacaccagaaactacaaaatgttactgaaagaaattaaagaagacacaaataaatgaaaagacatcctgagatcatggattataggatttaatattgttaagatgtcaatactacccagagaatctacagatttaacgcaatccctataaaaatcccaatgatgtttttgcagaaattttaaaaaaatccatcctaaaatacatatgaaattagaaggggtcctatatagccaaaacaatcttaaaaaagaacaaagttggtctcacattttcctgtttcaaaatttactgtaaagctacagtaatcataacagtgtgatactgatataaagacagatatataaagcaatggaaaagaacagagagcctagaaataaaccctcaaatacacatatggttaaatgagttcatttatttatttatttgaattgacaaaaattatatgtatttattgtgtacaacacatttttttggaatatgtatacttcgtacaatggctaaatcaaactaattaacatatgcattacctcacataagtttttttgtagtgaaaacacaaaatctactctcttagcaattttcaggactgtaacatattgttatgaactatagtctctatgttgtacaatagatctcttgaatttattcctcttatctaactgaaattttgtaatcctttgaccaacatcttcccaacacactccaccaccaccctacccccggtaaccaccattctactttctacttccatgaattcaactttttcttttttttgaggtttttttgtttttattatactttaagttctagggtacatgtgcacaacttgcaggtttgttgcatatgtatacatgtgccatgttggtgtgctgcacccaataacttgtcatttacattaagttccacttgtaagtgagaaagtgcaatattagtctttttctttgtctgacttatttcacttagtataatgttctcaagtttaatctgttgccccaaatagcaggatttccttcttttatgaccaataatattccagtgtgtgagtgtgtgtgtgtgtatgtgtgtgtgtatcacattttctttatccactcatttaatgatggacatggacacttaggttgcttccatatcttggctattgtgagtaatgctgcaatgaacatgggaatgcagatgtctcttcaaaatactgatttactttccttcgggtatatacacagaagtgggattgcttgattatatgacagttctatttttaattttctgatgaaccttcatattgttttccataatggctgtactaatttacatttccaccaacagtgtgccagagttctcttttctccacttcctctccaacacttgctatcttttgtctttttgataataactatctaatatgtgtgagacgatatctcattgtggtttcaatttgcattatccgatgattggtgattttgaaaatttttcatatacctgttggcaatttgtagattttttttgagaaatgtctatttagattttttgcccatttttcaattacgttatttgttttcttactacaggtattgagttgtttgagtttcctctatactttggatattaaccctttatcagatatgtggtttataaatattttctcccattcagcggtttgcgtcttcactcagtttagtgttttattggctgtgcagaagctttttagtttgatgtaatcccacttgtctatttttgctgatgcttttggattcatgttcacaatatcacaatattggccaggcaaaagtcatggagtttcctctgttttcttcttatagttttatcattttgagtctttcttacatttcagtcttttaatccattctaagttggtttttgtatataatgtgagacaatggtctaatttcatttcttctgaatgtgaatgtggtcaaatgattttcaacaagggtgacaagactatttacaaatggttaagatggttaatgtaaatggttcataaattttatggtatgtatattttaccacaattaaaaatttgtaactataaacatgtgtaggagacccaaacttttctgaaatagaagatatatatgtatatatgctggtttatatttgcagaagcaaggataaaggtgtcaaagaatgtgcaccaaattcttaatattgattacctctagagcattagttttggaagagatgtgtgcatcttccaggaagggaaaagacactaatttttctttatatacctctgtactctttgacttgttacaatgtgtactcattactagcacatatgtttaatttaatagagtcagaaaacaatctacaagcaaaagtcattaaagattttagttagcaatttgtacattcactattactgaaggcaagaatattagatagagctctgaggatcctataacttgcacaaattgatcatagaaaggcatacttggtttgaaagttgatacatcaggttgtagttcatgttttgatgacactaatgttagtctttccaagtctggacaaattgtttataaaatcatgatcatagttaagtgaccatttaaggaaaaatgatcagttaagataaattctgcctaaaggttatcaaaggacaactatgacaaaacgtgccagggcgacacttggctcaaggctagtctgtcatgtgacttgcataaagaggcacttcggtgcttggcttccatgatgagccttcacttcgcccagagggcaaagaagaaacataatgagacttaattgtacaatggaaaaaggctattgaaatgctatttataactttataaacacctcaggtattagccagagactcacactgaaattgacatcaagaaaaggtgttgggtaaatatgcagctctagggaacatatcaaaggacagatatagaaggtacagcccaaactcagaaacctctcttaacacagctctcaacccaactcctgacaccatggccagctgttccaccagtgggacctgtggctccagctgctgccagccaagctgctgtgaaactagctgctgccagccaagctgctgccagaccagctcctgcggaaccggctgtggcattggtggtggcattggctatggccaggagggcagcggtggatctgtgagcacccgtatcaggtggtgccacccagattgccacgtggagggcacctgcctgcccccctgctacctggtaagctgcacacccccatcctgctgccagctgcaccacgccgaggcctcctgctgccgcccgtcctactgtggacagtcctgctgccgcccagcctgctgctgccactgctgtgagcccacctgctaaaagccaggttgctgatcgcttaagaatgaaaggggaagcacagcaaaattgtgctgatttctgaagaactgttcgattttacttggatgctaagtaccatgatgttgttaagctgctcagagataatgaaactcctagttaggacactgtggatgtgccgaattcacttactgaaagatgtatcaatcagtgttctggatagcttgcgttgcttgagcagaggaccaggatggaatagttcatcatttcagtgacatctctgctcccccaactctctcttgatgctcatgcatcttcagacctggtttttccttgaatatctctgattaatccaaataaaatgttttaatgtgcaaagcaaactgagttatgtcctccttctacctttaaacatgtcttcttgtagctggtattcaagagtggatttgcaatttgataataataccaaggcataaccataaagtctaaaccagaaagattaaatacaaagtaaattatgcttgaatccatcagcttaaaaatgctccatgaattaaagaatttttatagttcaaatatttacatgctctaatctattatgattaggtctagaccaataaaggttgacctttagctaaaatgttaaggttgatcaaagctattgatttctatctaaatgtaattctaccatcttttgtctccttccatttaatatactaaatgttctccttcatttatgccccaaaatctaaagaaattgcattaccttctaaatagatttaaaaatagctactagatactacctattttccaagagaatttaggtttaatttctacaccttagcctttcacattcttcccactgatccttgaattgctctctaagcttcaactcccactattcaccttcatttgatgtacgtatgcataaggtgtatctttggtctaaatgatagtagaagaaacagctatagagagcacccgctgagttctaccattgccatttgtcagacagaagtgttagaaatctgaaacagctcgattatattttgcactttgcaacccaacttaaaagatattctcttaagaagttaacacgctggacacggtggcttacgcctgtaatcccagcactttgggaggctgagatgggtggatcacgaggtcaggagattgagaccatcctgactaatatggtgaaacccagtctttactaaaaatacaaaaaaaaaattagtcaggtgtggtcgtgggtgcctgcagtcccagctacttgggaggctgaggcaggagtatggcgtgaacctgggaggcagagcttgcagtgagccaagatcacgccactgcactccagcctgggcaacaagcaagactctgtctcaaaaaaaaaaattaacacaacctagaacaaaacaaaacatattttaccatttaatttttaaattcttcattaggcattagagtgtaatacacaaaatacaataggatgcaaatatagaaagaaacacgttttccacattatttacaagctcccagaacttacctctatatttaattggtagcaatgatggattacacacaaaattatgcaatttccaagaggaataaagtagatggcagtacatttttcaaagtgtcataactcctagatattttttcccgagcccggttccactactaaatccaaaaaataaaataaaataaaccaaaaaacacatttcctagtctctttacagcaaataacaagactctttcatgagaagtactacagcttgaaagttctctttaatcatgtttgagtggtattgatatccatgaatcaagccttttactccacctattcaataaacatttattgaatcagattcagtaaacatttattaaggttctaccacaaactaaggactctgctggataccttcctaaatactatgtcagtttggttcccaagaacagatttctggtctggaacaggaataatagtcacacattccaaattggttgaaatcaaaggaactataatcggtaattcaataagacattggaacaaaaaaaggtgaaatctgcgaattatgtatgaccaaaggtattccttcagttcagtagatatccagatatccaaaattcaataaaatttagtctatatatctaggaggaaaaaataatagttaaatataacagcacaattattactcttagccttagaggtatggatagattgtcacgtggaataactattatgtaaaatgagagcattcatttggactaaaatggaagtactctttgaacatgggaaaccacaaacatattccaaagagcaaaggactgatatgaggagtccagaagaaactataaaacagtaatttctaaactattgctcataatgtgtcacaagtatttcaacataagccaatcagagatccacggagtaacaaatttaaacaaaaacaaagaaaatatgttaacaattttgtaaacagcagctggttcagatatataaaaggaccaacgtggaagtcaccaccaaacctcagaaactcctccaagcaacctaactcttaacccaacttctgacaccatgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctgaaagccagtttgcttattttcaattgcctaggtcacagtgtctctgaactgttcatcccttgaccacctctggaccactaacaagttctcagactttgcattgcttgtgatggagactactaagtatatgagctcacaattctatctgattccattctacaatgaataccttgacccttcactggggacacagaaatgctacaaagccacctgctgatcatcaatttgcttgggatatactatttctgatatttctgcaggattaaaaattactgacatgttgtggaatttatccatgagaactatccacaagtctaatgtttccatgctttataatctattttatcttgtttacctaaaattttttgcaacatcaaagacaccaaattatagccaagtgacattcctcaagtcaccagagagaatggaagctcatcacccaacattcagcttctaagaagtaggctggactttccacattttaacatctgatccatcccttggtttttggatcataatgatcttgcctgctggatatttcagttatatctgtgatacaatgtcttctgtcatttcttaataaatattatatactaggcaaagaaaccattgtctttgttttcacttgtacatcacctggtttaactgcttataattcaagaatgtctacttgaggccaagagcagtggttcacacctgtaatcctagcattttgggaggctgaggtgagtggattacctgagctcacgagtttgagaccagcctgggcaacatggtgaaaccctgtctctactaaaaatacaaaaaaaaaaaaaaaaaattagctgggcgtggtagtgcacacctgtagtcccagctacttgggaggctgaggaaggagaatcgcttgaacccaggaggcagaggtttcagtgagctaagatcatgctactgcactccattacactatgcaataaactgcagcaagctctcaaaatggcaatttcctatatatgacaccaaagaagacataaagtgcattaaaaagttaagtaatggtaaaaagacacatatttccaagtcgaaagcaaatgtgggagcttttcttttattgaggatcattggccatgtaagggtaggtggacaacgaaagggatgaagcaagatgaattaaggtatcgaaggatggagacaagaatgaaaagggggagaagagaacaaaatataggagaaaagacagagagaagacacagtgaaaaaggctaggtatgagaggctgaaagaaaaggaggaagagtgatggagaagacacacctgaagggaaaggaggtgaaccagcgtggccttgttagtaccatatgctgtgcatgtgccaggtacacatcatgcgaactttgcttcacataacatctatactgatcctgtgaaatagatattgtgatcctggcttgtagataagtaagtctaaaagaagttaaatagcttgcttacagtcacatagctcataagtttagaaacaaaactgaaatctgaatgcaactctgtctgactccaaaatttatggagagaatgaaattaagaaaatagatataaagaaacgtgtgggaaagtttgtaagatttaaagacggctatttcagagactgtgggcttcagaataagttactctgtgctgctggttaagttgtggtctcagaactccacatcctccctacgatactcagctttatgatgttagtgatgaaatctgcaagccacattgttgcttttccagctctccatattaggccttgctccagccagccagcaccccatcctcagaattctgagtcaggtccactgggactatcctccaagttcagagccatcagaatatgtcaagaaaaaatatgactgtcagttctgcaggacccagcctctaaacttacacattttaataactcctaactcttccttgttccttcaaccctagggtcagtagctgcttcctgtagttgctacttccgtgttcaaataattggcatggattttgtctcctcactagatgctgactgatagaaaagttgttaccaggagtggccctggaaagtagaccttcatagatgggacttggggattgctttggtaaagtccctgagcttgaacccagtgttaaactccttgccaataaaaaatgaaatgcattgcatgcaataacatcaccattattacttttgttgtttaaataaagcacctattgaaataagtggcttgggggctcaagttgctgctgctcttgactattaagacagtcatgatgattataagcattgttgtggaggatgtcttctgagtgtactgtgtgctttcagaaagaaaaatggcaaattcaagaccttaatatctcaggtcaggtcataatcagagatacagaaaagattcagcagcagccctaaaataataacttgtttgttatagccacaggactgatactgccccatattaaacactaactaaatttaattgtgtgagttgcataattgaaagttaagctgaattcacagcttcaacaagactgtcatgtgaaagttagggaattgataaagaagaagttttagaattgaaacctggcataaggatttctgtctgaactcaaaggggactgaagatcttgaatctccaagtcattctgagcctcctctaccagtaaaaatagatttccctcctgagtctgatgagaacagctgtccactgctggaaaatcctctaataacctcacttgggaaatgtacttatatggaatgcctattgtgctgaatagccaccataactataaatttttcctactagtcctgtatttctgatcacatttcagatgctccatagggcaaatacaatgtatgatccaggaaaaatagctcatacatgaaaaaacatgcaataggccaaaatccagaatactgacaacaccaaatgctgacaagaatatggagcaacaggagttctcattcattgctggtgggaatggaaaatggtacagccactttggaagacagtttgatgttttcttacaaaactaaacatattcttaccatacaatctggcaagcatacaacttggtatataccttaaaaagttgaaaacatatgtccactcaaaaacctgcatatggatgtttaaagtagctttatacataattgcccaaacttgaaaacaatcaagatgcccttcagtaggagaatggataaactgtggtacatccagacaatgaaatactatttagtactgaaaagaaatgagttatcaagtcatgaaaagacatagatgagatttaaatgcatatgactaaatgaaagaagccatttgaaaaggctaaatactgtatgactccaagtatatgacattctgaaaaaagtaaaactatggagactaaaaaaatgagtggttgccaggggttggggtaaaaggggtggaataggaacaacaaaaaaaggattttagcgcagtggaactattctgtatgatactataaggtgggtacaaattatgtatttatccaaacccataaaatgaacaacaacaaaagtgaacccaaatgaaaactatggactctgggtgattatgtgtcaatgtagatttatcagttgtaaaaaatgtatcactctagtgggggatgctgataatgggggaagctacacatgtgtgaaaacagggtatataggaaacctgtgtgctcgattttgctgtgaactcaaaactactctggaaataaagtgtatttttaaaaaacattattgtattattatatattagcagaaacctgaggaatatgtgtaagtgtatttttggggtagtaaaccaaagaagatggaatatgacactcttatagtctcacttggggaagttgcttatatggaatgcctaaatgacgtggttacacttaaagattctggatgtaaattttttgtacaaagaattatttgatttgtttgtttaaacttgaaatcaaccatggcctatgtttactgatgctcagatgtcaggacttttttgacataacataaaggaaaggaatcaaagacttaaggagataggaattttggagaagatttatcatgttacactgcacacatacgcagcaccaagtaacttcccaaaagtcccagagaaaactgccttcactcaaggattttatattcatgggggactcttgcagtagcctagatatgatggtggagatactccctctccttgatttcagtagagataataggatctcagagcactggaagctaagtcacaaaacttgactaccaaagtaaaagtaagtgcagttggcctgtttgaattacatgggtccacttacacgcagatttttttcaaccaaacactgattgaaatacagtattctcaagatgcaaaacttgcatatatggagggccaacttttcataaacactccacagggctgagcgtgagacttgaatatgtgcagattttgtatatgcaggaggcctggaaccaatcccccccacccagtacactgagagacaactgtacattcactgtaaagagaaacagagatatagtggtagccagaatgctttgacccacagggatctgtcagtagatagtttattatggtatccttggaatgaaattaaggggaagcctattaaaatgttggttgatatctatactcagatattcaggggattgtattagtttccaaatgctcctctaacaaattaccataaaattggcaacctaaaacaacacaaatgtattatctcacagattttgtgggtcaggagtacagcagggcatggtgagattctttgctcttggtcttacaggaataaaaccaaagtatcagctggtcctcatctgaggctcagtcttcttccaggaattgttttgttggcaggattcatttctttctcatgttttcatatagtcccctccatcttcaaaccagcagtggtaggtcaagttcatgttatactttgaatctctgatttcctaccctacccccacttccctctccaatatcctcttctgctgtcagctgggaaaaaaatgttccgcttttaacggcacatataattacactggacacacctggataattcaggctattgtcactatcttgaagtccactgattagtaaccttaattacatttgaaatgtcccttttgttatgtagcagacatgctacataacatccccaagtcccatctatgaaggtctactttccaggaccactcctggtaacaacttttctatcagtcagcatctagtgaggagacaaaatccatgccaattatttgaacatggaagtagcaactacaggaagcagctactgaccctagggttgaaggtacatgaccttgggtcatgacacaagggctcagaggccttggaggctgaaattctgccaatcacaggaactattagacactaagttgacactaatttctagagacccaaatgccactggtcctccaaaaaaaagtggtgacttttggtggccagatgatagttagaatcttggtctacgtttgaatcacagtggacccagtgggcctgcaggacaattccccaatttgtgaatgtataattggaataatcatgtttgacaactggcagaatccccacattggcactgaggaataaagctcatttggtaaaaaagggccaagttgaagcccccagaagtttccttgatacaagaatagtaaataaaaaataatactatattgatgggaaaattttgaagatgggtgccattatcagagacttggaaaaagctgggttgtgatacctaccatctccccattgagcttgtttatcccgtagacaaagcagataaaccctggagtataacagaacaattatgtattattattttaaatgaattcaggtgatgacctcaactggagatgatgtcccaaatgttgtatcttgaatggagcaaattaagacagcccctggcacctggtatgcagctattgacaagaaaatgcatttttctctgtatcagggcagccagaagtacttttctttgacctggcatggccaacagtaaccttccaagcattgcctcagggctatgtcaactatcctgctctctgtcctaatatactcatgctattaatcatcttgactttccatacaacatcataacagtccactacatcaatgacatcttgctggtgacatttgatgagcaggaagtaacaagtaccttagaggacttggtaaaacattaatgaactccagggcaagaaacaaactctacaaaaattaaaaagctcacagcctcaatgaagtttcttgaagtcaaattgtctggaacacactgacatatcctttccaaggtgaaagaaaaactgctgtattttaagctaacttcagctaaaaaggcacaactcttggtgggcatttttgtattttggggtcaacatatgccatatttgagtgtgttatttcaacccacttaatgaataactcaaaatgctgctaggttttagggcaagagcaagagaaggctctaaagaaaagtcccagctatgggcgtggtggcacgcacctgtaatcccagctacttgagaggctgaggcaggagaattgcttgaacctgggagacagagcttgcagtgagcccggatcacgccactgcactccagcctgggtgacagagcaagactccataaaaaaaaaaaaaaaaaaaaaagaagaagaagaaagaaagaaaagtcccagctataattcaagctgctatttcatttgagccttataatccagcacatccaaccatatttgaagtgtctatggaaaacacacgctcaccgtatatagcctctggcaagcatcaatagaagaattacaggtcagacttataaggttttggagaaaatccatgccctcctctgaaaataactactgtccttttgataaactacttccggcttgctagtgggcaagaactggaaaaaatggaatgactgtgcaacctgagcttctcatgcttagctgggtgttatctacccaccaaactataaggctggatgtgcacaggagcaatctattaaggcaggggcccccaacccctgggcagtggaccggtaccagttgtggcctattaggaaccaggcagcacagcaggaggtgagccactggccagaagcattactgcttgagctctgtctcctgtcagatcagctgtggcattagattctcatagaagcgcaaaccctattgtgaaccgcgcatgtgatggatctaggttgtgggctccttatgagactctaatgcctgatgatctgtcactatctcctatcactcgcaggtgggaccatctagttgcaggaaaacaagctcagggctcccattgattctacattatggtgagttgtataattattacattatatattacactataataataatagaaataaggtgcacaataaatgtaatgcccttgaatcatcctgaaccatcctacccacctccctggtccatggaaaaattgtcttccatgaagccagtccctcgtgccaaaaaggttgggggctactgccgtatgttataccccaagctaagtaagcttcatattaacctaatttcattgaatacttacatcaatcctgtaaaatagatactgttaccttacctttgtagatgaggaaatcaaacctaaaggcggttcaatagtttattcataagtaaaaaacagaaatacaaacccaactctgaccccaaaattcatgatgagaccatgaagttaaggaattggaagtaaagattggtgttgggagattcagtagatccaaggatatctccttgggcagctgtgggcttcagaataagttcctctttgtgcccattatgttcctatttctcggcttcaaggcctcccttctgtactctgcaaaacacactgtggctttgaccgcagttctgttaggcttttctactagggggtgacagaggaaaactgcaaagctggaataggaaggcaggatttgttccttccttctgctccatttgggacttcctgtatgctaagcagatcccaggataatcgccccaagtcacacttctcactccagcaggtgcagatcctgcccatggcagcacacgaattcagtttgcagttttctcaacacttgaagaaccagcttcattgtctcctttccagggtcaccaggaccaaccagtcctctcttaaaacaacagtttcagcgctacaggacatctccctctctaaggtttaattccttgcctcctgcatttaaagctaggcctttaaagcttccctggaaaactagggctttctgcagtttccacatttgtggtattttagggtcctctttttttacctagtgaacagcttaaaaattattcttatgaattttattcaatagaaaaagaaagggtttggttctcatcttctgcgggaccctaactgttatactcttactgcctttgaaaaattagattatttagtgagccatttgtacagaatgttcacttactccctttcattaatcaccatagtggattatgagaaaaaaattatatctgagctttggagatggcagtcagagaattacagcattttagacctgttagaatccaattgagaaactagaaagattactcaacaacattaagctctgtagttaagaaagttccaccttttctatcaaaggccttccatgaaaagtgggatgtgcccagagacctgactgcagacggccctttgttaatgactgacttatccccagaatcataactctgacttaagaaacctattctccatcatgattattctgttaagtgcgattagacagaattagttttaaaagctcaaagacacaaagggatgttgagaaacttgaagggagaaaatgttgaatcatcacatcaactaaagcatgaaagccttgggtaagaccggagatttgagagtttagtaaaattgttttgtgaggttgagagagactaatccaaagcaccaactattatgagcctatgttgggcctattcatttctaagcacgttctcttttttcttctttgttcttgcattacaaatatgggatagagaaacaggagtggtagaatacacaacatgaaaatcaaaattcctggcttttaatgggttaatatttaacatacaaaatttcgacttttattttctcaattttttaatatcttatttattttagttgcatgaatgaaacaaacgagatattttcccaaaaggatcagagaaatcttggtccaaatggggccagagtaaagaactacaattatgttatctctaagacagtactgacttgttcaaaagatgacacctgtgaccctggaaaaaaaagatcctagtgggctgataaccttacggtaggaagaagggaaagaactcaggattttcagagcaactgaagccaggaagcatgaggaagtttgagaagagttagagatggcagaggttgacagcaacagccacaaaaaactctgaacagaaggaaattcaacgttctctattcaggagaggttgagggagacaaaacaatagaatcctagagatagaattcaggaaactctgaggttaacatttttgccctttactccaacgcttgttggtttagtgatcagaagggaccaaacagaaagagaactgcacaaaagccagggatagtagttagagggaaccagaagctgagactagaagtcatacaaaacacttgttttgtgtgttaacgtgtactaagcaaaacaaacttgttatgttgtttctcaggggtccccaagccccgggttgcagagcgatacctgtccctggcctgttaggaactggatcacatggcaggaggtgagcagccgaggagcaagtgttcccacctgagctttgcctcctgtcagctcagcagatcggcggtggcattagattctcacagaagcgcaaagcctattgtgaaccgcacgtgcgagggatcaaggttgcacgttccttgtgagaatctgtctgaggtgggacagtttcatcccaaaaccatcccaccttcatcccacccacagtccatggaaaaattgtcctccatgaaaccggtccctggtgtcaaaaagaatggggactgctattgtatttgagtataggttgacactttaatcactctgaagatgtttttaactgtaggaaggggcagagagtgggatgagaaaggaatcagaagacctgagtttaaaatcccaactctactcactcactgactgtgaccttagacaagtcttctcagaagctcagtttttgtcttctatatcaaatgggggttctaatatgtcacagtattgctgtgaataacaaataaggttattaatagtaatatgcctggcatatagtaggtgctccagaaattttattttctattcctcttctccactcaagtgtatgtcttcaggagcagaaagcccttttggctatggagaggatagcatgagccagatagtcatgtgtggaaaatagctttaaaaataggaagagcattgctcagggtgatgttgtattccatttgaataaaatggatcacataaaaatggtcatctcattctcagtccaagcgcttcatagtaagcacagttttcatctatatgttggagccttccaaatcttcacctccagcactgagcgtggtgtactctcgaaaatcaaaacacacaatattagtgggaacgtttatctcatgttatcttcctcctttctgctcttttcatcccaatggactcagatgtcaaatttccactcaggaaaactgaccggctataattacaagctgttgcaatacatcttattctacagaggaaatttttaactgtatcaaaatataaattgtgtcacttcatgtaaatcacagatagtaataagaaagaatgaggaagaagtcacgctcaagcagctagagcatttcttcagtcccctctgagtaataaatcctgctaggcgtttgtgatgactgcctcctgaaaaaggcaacgtggtagaggggacatgaggagtgcacactgcttaccagtgatctcacagggttccagcaaagcaaggtcgaggggcacagtttgctttttggaggcggggtcttcactggttacaaaaactataatgaagactatcaacaggcaggctttccaggcgtgggaaacctaaaagctaaactcccaaatttagccctagattccctatcgtcggagagaaagaatacctgaaaatgacggggaagaaaaaagctccagcctccctctgcttatttagtaacaacaatcacacctattagaatcatttattgaggacttactatgttccaggcactgcattgcacattttaatgctttctttaatttattctttaaacatcctatcaatgtgatagtaacattagccatatttacaaatgacggagttaaagaggtaacttcctgccttagaaaaatatataccagtggttctccatgggtctacttaattcaagttcaaacacctcatcctggggtcaagactctacatcttgcttttatctcacacaattgttctctagacacagcgcactattcatggcttcctaacaaccatttgttcttttccacttctatgcatttactgctgctgttccctatagctggaatgccttcctactcctctgccttgcattcaagccctgtgtaccctgcgaatcccagtaaattctcagatatttaagagtacaccatgtcctgcttgtccttgaatgccttaaatctcctagcacagtacaaagcaaacagcaggtgctcaacagagataggttgaaataaaccaagttatatattttctcttgaaaaatgcaataatcaataatagagaaattataaactaatgtatagtgactaagaatgcagactctggggtcaggtggccttggttcagattttaattccatcacttaccagctattgactttgagcaacttacttaaccactctatgcctcagtttccttcagctatgaaagagaggatagctttaataccaacctcatagggctgtggtaagaattaaatgacatgatacgtgtagtgcacttttaaaaaaatctgtcacacagaaaattctgtatgagaatttgcccttaccatatagccaactatatgtttagtaaaataagctaaaaactcaaagtatattttaaagccatagtgtcagctaatatttaaatacataacaattaagtctcttcaaaaaatttcaagtactgcaggagctctttggaaaatcagtggtcattcaattcaatacagtagtcagatttatctaatcaatggagaaaaaagtctctgattcaaaataaatttataaagtacaactattgttagaaaataattccaaggatgaaaattccaaagcttactctagaataattgtaagtttaaatatctcaatacttcacatagtaggcagctgaaaattttattttaccagtgcctggcatatagtaggtactcaaattttatggagtgtctattttcctaaacatattaattttagttaacacatatttttatatattagttaatcataaagaattatctgttactatctgtatactccacagcctacaataatacataagaattaaactgaaagcctagggttcccaggaaaaataggtaacacttccagccagctggctaagcaatcacttgcaagaatgttgcatgtgccacgggactgaaagctatgagatcagccctgcatgttgccagatgacaattatagagactatcagatgtcctcaagtggaaaacaccactacttccatttaaaagaaattcaatttgggggtaattttcagtgcaagctaataaggtgatgagatatatcaggcttgactataaccacaaactggaaaaaaaaaaaatctgatgcaactggaaaacactcccaaagttcaccatttaacccaagcccagaatcctttgcatgaattttcagcatatagcaaagtaaacaaagaataaattgatgtcaatggcagccttgataccagccattctttctttcaatctatactataaaggaatgcactggcagtttcaaagatcatgcaattcaggaaatgaagaccaaatgtttttatttactagacatttttattaggatgacaaactttaaaggtttctatatcctgcttttgtgaagggatgaagaattccaacaggctttaggaaaattgagtggccctaaggtgtgaagcttcctaacatccctgctgactcaggaggtgacactgtggaaggtgtttcccaacagccacccacaaattcactgagttgttgggagatggatattcgtaaggcacaaagtggctcacagcaaaacatgactaacgcacataaaagtgactatctcgttctcagtccaggcacatcattgtaagcaaaatttttcctgtatgttggagcctcccaaatctgcacgtccagctctgctccctctcacggcttcaggatgctttgtctgtaggtcccaaactaaactcatctccaatccctttcctatcaccccagacagcagctgtttctacgagtaaatctgacacctagacatgatccttggctccacacatcctctcaatcagcatgacctatcatctccactttcaaaagggcttccaaactctaccacttcttaacagttcatcaaaaactagcatcaactgtctatcctcacactttctagtcgtgccagtttccactttgctctgctgtagttcattttcctttgaacataaggaaaatgttatcactcccttctttaagtcatccagtggatttcaacacccttagagtaaaatctaaactgtgtagaacaactaaaaaattctacatggcctgccacctgccaccttctgtaaccttatttcctattatactccttcaaaatcctacacggcctgccacctgccaccttctgtaaccttatttcctattatactccttcaaaatcctacacggcctgccacctgccacctgccaccttctgtaaccttatttcctattatactccttcaaaatcctacacggcctgccacctgccaccttctgtaacctcatttcctattacgctccttgtcttcactatagtccagccactctgaccactctaactaaggtaatacactccctggcacttctctggagttcttatttattcatttgttagttttcttattgtctgtctctcccacttgacaacaaggaccttatctgacctgtttattgctctatgcttagcacctagcatagtcttagacattttgttgagggcattaataaatttaaaaaatacatgagcataatctacaattatataaaatttaattccacaaaaatatcgattttgtgcaaactattgctattaggtgagccatcgttcactagtagtgtgactttagaatcattacttaatatccttattcttggtttcatcatctgggaaatgggtacagtaatagtgtacccaatagtgatcttaaagggttgtaagatgtaaggaagaagatgcacaataatacttagcaccatgcctgacacatggtatacatccaatccatgaaaagtgttagcagaggattagtgttcccattaccttaaaaacaaaaatattaattttattgtggaaactgctgtaccacccagatggtggtccctaaaaactgaatgatgtgataagaaatctctggtaactcccacttctctattcccacaaaactatgatatcttctaagacactcctcactcccctagaacacccaaatagtttcctaattattgtccttgtcttcaagtttcctcctttctacagcatagtcttttgattaagaaaatagctctaaactcaactccccttgtggtcccaagaccttcaatgacctggcctcatccttcctaccaatcttacactcaactaatcttgagggtcttctgcactgtagtcagacaatacccctaaagcaagagggaatctggcacagtgattaagaccatggagtctgaagccatactgcttggcttcaaatgccagctactcacccactagctacttagcctctctatgctgcaggttcctcgtctgtcaaagggcaaggataatatcattgcatacatcatcataaggttgttgtaagaactgtatgaaataatgcatgcaaagcactcagcacattacctaatacttagtaagtggcaatgataaccatgatgagccttccctcaaaaactacagtatccttccaaaatctagtcatgtcacatgcctgttcagcaacctttacataatgcctattgcctacaagataaagttcaaaatcctaagtgtaggatactaagcacagtacaaattcttcatactgtggcactaacccacctttccgtcttcattccaacagattcagaacctatgcttcaaccaggcaacactttttgtcataccatgggggccctgtggcattttgtttcaatggctgaaatctccttcctatttatttctatctgctcagctccttttcacccttcaagatccaaacagatgttctctttttgtgaagggcttcctaagttttctaggagaagtctgtggcttctacctctaaattctcatatcataacctggaaaatctaaatgtacaatcctttgttattgtttgctggtttacttctctgtgtctgtcttcttctctatgacccctgtaagggcaggagcctattgcgactttttgcatgatgcccaacatacaacaggtgttcaatcaatgagcattttatatgtaaattctaattttgatatgtaaatatctaagagagatgtaaattctagcataggaatccaaaactgcaaaatcattccaataagaaaatggctaaaaagaaagcagtttcatgctaagcatttttttaatccaacatcttgttgatttgcatctcatttggcttctgattcctctgcattgtgcaattttctactttagaacttgagccatcttatctgaaaaaatgggtcaagaaaatatgtacatgtttttaagcctttctaagtaagccatttctaaaggttttaccagtttagtatttttcatattctaaagtaattctaaatcatcatactaaattttctacctttatctacttttaaaactttatttttagagttttagtggtttagatgaaactcggaaatgtctctattctggaccacagagcctggaagtaagacaggggtgttcaatgttttggcttccctgggccacattgaaagaagaattgtcttgggccacacataaaatacactaacactaatgacagctgatgagcaaaaaaagaaaaaaaatcacaaaaaaatctcataatgttttaagaaagtttatgaatttgtgttgtgctgcattcaatgcctttctgggccacaggttgaacaagcttgctgtaagatgttgctaaatctccccaagtatgtttcataaagcactgacctatagagctaatctctgaaaacaaacaaaaagcagtccatggtcaagtaagtttggagaaaaatatatgctatatctctgtattgaaaagtcatagagcattttagcacattaaaggctccgagaggcccaacaatgaagaattcagcatttcccaaacttacttaccagaaaacactttcaagtcccttggaaccagtgttcatggaactcagtctggtaaatactgcatcatttagcttctgaatggcccaatacaaccagccttttggttataaataatctccatttataacacagttggatggagcttaaaggacacccatctttgtcacccatgaaggtcttcattcccacctgcatgttcttaccaagttattgttcagagcatatttgaaaggaatgcagaacaaacgatttgttatagctctgtttgaaagtgcctctttacacaaaaccaaaatctatttctctatagattctatccattcatcttcattcagtttattggagccacaaataataaatctaaaatgttatatcactttttcagcctgagggcctaaaggatcacatagaacctgtagtcactggtagaacagcaaacaaaaagcttacttgtcctcttcatctgaaaagtaaacaaaagaagtgggaaacgtttgcagatgcctggcataccgagccattattagtgagggtataatgattagaagataatggcccggtacctttgaagactggaatgaagatttctgtgtagtgacacactggcaatgtgaatagtcctaatttgacaacaaaacaacctaaatctcttttatgaggtgagcagtgtatcttaggtaataaacacttaagtaattaggcattttttatggaaataactataaactgaaacatgggggaaaaaccctcagtaataggctgacgcccagggagatgggtatataagagccagagcagaagagaggagcatcgagacaccaacagacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggcttagcaaatatgaccttgtgattatttattttcatgtctcccattagggaaagtggaatgcctacctaaacctgaacagtaggttatcacactatccaagatttaccccaacagaataagagctctcatagtggaatttatcgaaaaaatagatactggttatttgtgataagttaaaaagtaaaaaatgtggtagttcattttatagaagctttttatttaacagatatttatttaatagatattattggaagacatccactgtgcaagcactatgctagagtctagagattaacagaatgttttaaaaatacttgattttagtttccattgattctgacattgatttttctttcttccttaattgactaaatgaattgatcactgtgctggtgtgtataaataatttgattatcctagtcctcacagtcatctgaaattctgagctcaaaatgcaaagcaattttgagaagtgtatatatccatttcttcatatatgctgtcttccaaaacaatccatttttaattaatgttagcatttatcgagtattcattgattcctcaaatggggcttacattggtttacattagtcatgactatgattagaagtttgctagtctaagtgacatataatatcatgacattgaaatatgcttaaaatatcagactacagtgtagtattttctatacaccagaaatagtcacacaattctgagagcaaaaacacacagtttctattagaacaaaactactacgataaccactaattcatgtccttatttatcttagaaaaatctaggtgcaattaggtctttgcaaaaaataaaggtattgtgattatatatatatatatatatatacacacacacacacttttggacttgcctttggcctttgggccaattgcttccctctcagtctcaatttccctgttattaaagtgatttcctacctatagcgtggtttcctacctatagcttggtttcctacaggctcagttagcttgttattactctctgccctgcttttgtctcaggattattgtgaggaccagatgccctgaagtgtagaaaccaccgtgtccacagcatcaacctgttacacatgagagactctcaccattactgccatatggaagttcccaactttctcaccaaaagacatcttttaaaaatatttatttatttatttatttatttatttccgtagcttttgggttacaggtggtttttggttacatggatgaattatatagtggtggtgaattctgagattttagtgcacccgtacccaaggagtatacatggtagctaatgtgtagtgttttatccctggcctccctcccaccctccactttttgagtctctaaagtccattatatcactccatatgcatctgcatacttagtttagctcccacttataagtgaaaacatggttttttgttttccattcctgtaatttcccactccatttcactcagaataatggcctccagctccatccaagttgccacaaaagacattgtttcattccctttaacagctgagtagtattccatggtgtatacataccacagtttctctatccactcattggatgatggatacgtaggttgggcatctttttatttcttgaaatatgtatttttcccaaatggctttcttaaaaatgtttattaattccttcatttgtgttcataaatacatttataaatatcaattaaatgtttaggattactatagaataacctttgttaccatgccaagttaccttttttctagtcaaaaacaaagaattttcatgttttcatacatgctagtaagggataaaaattagagtttgtttttaatacctaaaataactcgaagttcctattactactaccatggtctttagcattcacgggccctggcctagttataaatccccaactggaaaccagaagatgtgttgttttagtcctggctctgccttgagctgcctctgtggccctaagcaagtcaattaagttcttggggtctcaggtgttaaagcagtaaaatgggttggttgatcacaccatctctaaggttgcttttcgttttaacattctatgattctagatcatccagaagcattctaagtaacaagtaccccatgcaactaaccaagcccattctacctcattacttttactgctttcattaggaatagctcacactgagtgagtatctactggacatactaatgaggtagaaggtgggactctactccagaagcggggctcagatactggaccaaattgagggctagctaaaacaggatggggacagaaacagctttccaatcagacatgcccaccagcatgctgtgtcaatttaccattgccatggcaacacctgagttaccacccctttccatggcaatgacccaatgacctaaaacttactactccttcttagaaatttctgcacaaaccactctttaatctacatctaattaaaagtaggtagaaatatgcaaaactgccctgagctgctactctctgcctacagaggtagccctgttctgcaggagcaatcacagagctgtaacactgctgcttcaataaagctgttttctacctctggcttgcccttgaattcttccctaggcaaagccaagaacccttgcaggctaagccccactttggggctcccctgccctgcatcactaacaggtgaagaaaggccactaacaggtgcagaaactcaggctgagaaagactaaattacttgcaaaagttacataaatcataagtgagagagaaggacttaaaccccaaactaagtccgaagtcccttctctttccactacaccaaagcactcaccttccccacagacagcaatatgtcaaagagaaatgtgactataggtggctctctttattcaggagaaagtatatgacacttgacaatatattctctactatccctgtcaattgtatcttttgttgttttctctgttttctctgtggtgattatagtctaaaataaaatgagtgtatacaatgagtattaaaaaaggtatccgtgtttctaagttaagaacaaaccttttttaaaaagtcagactttactgattagcagtgtcagcagagaagaaatattggctgcatcattaactttgaattgaaatgcagaatgtttggcaactcaaacacattttcagttcaacttcagcatcaataatcaaggtaaaacaactgcccttaacattaataattgtttatccttgataatataataaaaaacaagatatttcatttttccttcaaattgttattgaggccaggcacagcgactcgtgcctgtaatcccagcactttgggaggctgaggtgggtctactgtgagtccattaaacttctttcctttataaattacccaatctcgggtatgtccctatagcagcatgagaacagactaatacagtatggatgtgtctacatgtgagtaagtggaaaactacactgacaccattttgaaactacaacagaaagcaagtttgaatgcagcaacacaactaaataaaactgaaggagagctcatcccctgtctgatacataagaagttagtgagttatttttacagaattaggtaaacagcaacaaggatgttccgtccaacattctgatggacagaagccgtgttccctgagataggtggatataaaagacccatagaggacaaccttgtagaagaaagccttcctttgccacaaaacattgtcctggtccactgtcactatgtcttgctgtgattcctatctccaaggatgctgcagcgtccccactggcctggccaccactatctgcccctctgacataagctgtcaatgtgaagtctgcctacccagcacctgtcctcatgagatcagcctccttcagcccacctgctgtgaacctggcccctgcctggctgcatgcctgactcctatgtgccatcctgttgactgctcaacaaatgccacccagctccaaccctgagcgggctctctgtcaccacctgcatccagagtgtgaaccaccttgctgctagccaaagagcttgcccacattaccctgaggaccttcagtagtcattaagcgctgctcagcaaatggcctttaatgaggccatttggaagaaaatatagcactgtgccttcagttttacagaagttttcttttcctgttttgaacaatgatttcaaatgagaaatgggaaaaaaaatgctaccatggatccccttacttcaaaactaaataaacaccactactccccaaaccacatactgcctcaacatttaatgctataattacccaacgactcttgacacatgcatcatgaacttaaaaatacatccagcagaattacactttctgatgacatcaacataaatttcatagccaaaaagaggcctcacaggcatacgtagatacctgaagaaaactgtgaggatagtgaaatgcattaggctctaagcttagaatcgttttaaatgccaaggtcagcatctacctttgatttttattttttccctgcctctaaataaactcacgtgtccttaaagaggcagtgaagctagcaatttgagatcaacatgctcacagaaaggacctcaaagattgagccaagcccatttttttcgctgtctcatttaggtaaatctttgaatttaaaaatgttggccaggcatggtggctcacgcctctctaatcccagcactttgggaggctgaggcgggcggatcacctgaggtccggagttcaagaccagcctgaccaacatggtgaaagcccgtctctactaaaaatacaaaattagccgggcatggtagagcatgaatgtaatcccatctattcctcaggctgaggcaggagaatggcttgaacccgggaggcagaggttactgtgagccaagatcgtgccattgcactccagcctgggcaacaagagcaaaactccatctcaaaaaaaaaaaaaagttttgacaactgtaaagcaattcacacaaaaaatgaatcactctctttatataaagtgttactgttataaaaggccattataaaaataaataaatacctttttaattctaatctgaaatgtaatccaattcaacaaatatttatcaaatgcctaccctgtttcaggcattgtcctaggtgcttgaaaaagacaaataaaactaacatacgattaccacttccaagaaccttgcattggagtgaggaaaacaaatttaagtgacaaactacaaaatatagcagaaagaaatgaggttgaaagggaagaataggcagcccattttgtgagagcagagaaaaggatgcaaacatctagaagaatcacctagagtttctttatgaaggggatgtttggctgaatcttgagggatcaacaggatttggaaactagagaattgggaaaggtcactttaagctaaagaaacagtatgaacgaggtcacagagggtaaagtacctaggagactcccgccttcactttatgtaatgtgctgtatgattaacatatgcgtgactcacatagttatcatttttgtgatgagaacacttaatccattctctcagcgtttttcaaaaatgcaatatatggttattcactatagtcaccatgttgtacagtagatctcctgaatctatataatatttcaaaatcgattttaaaagagaagtcagagagaacacagagaatgggagagggtcttcttcatatattctacttgccaagccactggcttctagatgagagagactggtaagtcaagagtaagtaaacattaaacatttccttgacgatttcaatactagttcattaactttgaattttataatatactgggaaagccacttgaatttgcttatctgttcttcagtggtaaagtgcaggtattgaggcaggagactagcaaagggaattaaaacttggataaagggtggagtgaataaaagcagagaccagaagcaaggtgaaggggcaggtaagcaagaagcaagataagaagcagaagttagaccaggcgcggtggctcatgctgtaatcctggcattttgggaggccgaagcaggtggatcacttgagatcaggagttcaagaccagcctggccaacatggagaaacacccctctctacaaaaaatacaaaacttagctgggtgtggtggcgggcacctgtaatcccagctgctacttgggagtctgaggtaggagaatcacttgatcccagaaagtagaggctgcagtgagcagagaatgccactgcactccagccaaaacaaaaagtaagatagagaagaaagcaaggcccccatggccggcaagataaggaccaaaccagtaaggggcaactcttcatggataagcatgtgcattaaagagaaaacgtatccttaacatgaccttgtatgaaaatcagctcattcaggcttatgcatatggactgcatatcatgtatgtacttaaaattatgggctggaggtggtgcgcaagcacacaggggccaaagtaactaagcaacacacctgtcaatcaaagaggcaaacactggctagagattaggcagccttgggaagggacacacacacacacatacacacacacacacacacacaaagacgcaaactgcaccaagctgggggctgatctcatctcacagaggctggtttgctctccccctcttagagtgtaatactgtgcttaatacacttttgtttctttgttttgctgtgggtgtctcgtccaattctttgggacaccaaaagcctggaactgcatggcaccatctggtaacagtatgatgttcgacacccttggcatttgttgtaaattcctgctaataaaaatgatttgaagctgttttctgtttttttgtttttaacttttaagttcaggggtacctgtgcaggtttgttacataggtaagctggtgtcatgggggtttgttgtacagattatctcatcacccacgtattaagcctagtacctaccagttatttttcctgatcctgtccctcctcccaccttccaccctctgataggttctagcatctgttattcccctctatgtgtccatgcgttctcatcatttagctaccacttataagtgagaacatgcagtattcggttttctgtttctgcattagttactaaagataatagcctccagctccatccatgtttcttcaaaggataggagctccttattttttatggctgcatagtattctatggcatatatgtaccacatatttttgttgttaaagaaaaagataaactggttgttttaacgtataacgtataaggcttacctaccaatgacatttgatattttccactgattttagccagctttcttctcttttaagtagatcgtactggtttttggtaatgtcccctcagaaacaacctacccggaatctttgctttctgttaagtcaacaaattgccacataacgagtatgtaatttaaattatacaatattatctgaaaggatttgtgctgatcatggacaggtgtaggaagatgttggaatctagaatattacacatttgatattatctagttcaatctctggctgacttaagtaaataatgttgtttaaggcatacctcaaaggaatttcaatctagttcaagatccaaggtatgaaaacaaataaacatgcaaagtagggagtaagtcagtgaaaaagtgatttttatgaatgccatagttctaaattgcattgagtcagattccctgccaaaatccatgattgttctgtgactcttgtggtttctccttttaattcttatttcatcttattttaaagtatgtacaccattcatgtgaaaatgaatcaaggctgaggtggttttcttttagtggtatattcaacaaagaatggccactgtgtggatccttccttccaatgaatttatactttgattcaccacaagattggcataactttgagaatagagactattttagaaaaaaaaaatccatagaataatacaacattgagaaattcactacagatttaataaaaataataaaaaggagtttcttcatcctgtaccattctaccactttgcttgctcaatagaacctgaattataatatcactaaataatgcaaacatgtccgagatgcctgtagtcacatgaaacattcatctgtaaatagccatattcttgttgactttattgagttgaaaatggtccagttcatcatttgagttactcattctgaaattagtcattagaaatcacattatccatagtattttaaattaagagggaaaaacaagaagagtttggcctccaaaattacagctgaattgtcacttggattgattacccataaaagtcatataaggtttggcatgccagaaacctgtgaagacaaaatgtgatgatcttgtgacaaaaatgacaagtcaatgagtcaaaaatatgattaacttaataagagcgggaactcttaatggacatgtaaatgacaaactgattagagaatctcagtgaaaaagggtgccataaacaaaacaggaaggcttccagttggaccaatgcccacttgggagggtatataagagccctaacaaaagaggagacatttgtacctcagaatcctcatctaagaaactgaaagctaaccagacgcccattgccatggattgctgtgcctctcgcagctgcagtgtccccactgggcctgccaccaccatctgctcctccgacaaatcctgccgctgtggagtctgcctgcccagcacctgcccacacacagtttggttactggagcccatctgctgtgacaactgtcccccaccctgccacattcctcagccctgcgtgcccacctgcttcctgctcaactcctgccagccaactccgggcctggagaccctcaacctcaccaccttcactcagccctgctgtgagccctgcctcccaagaggctgctgatggatggctactttgctcagtgcccgacaacgaagaatccagaagctgtcccttcagtattcacttgcctcagtagtttgccagatgttaaggtagaccagatgacccagatatgaagaacttacctttggttttaatgggggaaaaaaagaaaagtattttttatggttatttagctgaaaaaccatttggttcctgtgggcaggtgaatgagttttattagcaaaatactgtttcaatctttaagacctcagattacatgttcttgatcatattgcttcctggctcttgtttcttgtactgggtattttcatagaagaaaatttcttggtgggttttccaataaactatatttctctggcaagatgtgtcatttgtttatgttagttttgggtatatttcttccattttaaaaaggtaaaaacaggatgattattttaatcttttaaagaagactctattggcagaatgactaacattcttgctactactaacatggcttgctaacttttaacaggttctctttcatgtttgccttctcttctctcttcttcctcagacaagtgcaattttggtgtgaaccaacatttatttatctactcttcaccagtaaattattgatttagtccttaaaacagcactaatggataagaaaaaatgaagttttaagcgttattcaacattctgaaagtcataaagttaattacttagaaaatcagaattcagcctcttgtatgtctgactctaaagcccaatttttcctaccacatcatagaaccttcaatactaatgaaaccagaagcttaatgagcacagttatgaaataaacccaaaatatgcaagagaaataaaacatgtaagattctttaacaaaatccacatcggattataatagaaaaagagtacattggttcatagattaaaattggcaagtattcaattctaaaatctgggcattttgaaggtgtacctatttcaacttcattttctcttagagagaactcaaagtggtcaactctagtaacaaggcaccagggacatacctttatttgccaccatactcagcacagatgttctaccacagtaatcaatagaatgccaatacttttcaggtgtctcaggttgagagctaaaactctgattacgtatgctttaattcgttacttaattttatcaacctacttaattttatctcatgaagatttttcttttccaagcctagagagaacaagtatatattatatatataatacatccaatacatttatgtaacacatataaatatatgtgtgtatgtatatctatacacaatacatatataaagacacaagtcaaaatctgaaaatgcattgaaataaaaccacaagaagacatgcaagaaacagagtaggacaaggaaggggagaagcaaatgctttttaacaaacttgttttaaaatgtcctcaatgtacctgttagtgtcttgagagagaaatttctcacgggattccataggctttttacagctcaaccttaaatgaacagaacttagcagccatggagtctatgggacactacagaggatattgtcaacaagagatctagtccattcactcattcatttgtccatatttcctgagtgtttgccctatgtcaggcatcatattgatgccaggagtaaaaagataaaagaaatgctattacctcaagtctcaagtgccctcaagtctctcccaaatctagtgaagaagaaagacaagttatcataataataattgcaatgctgagggattctgctgtgactgggaggtgagcagcatggcatgcaagcatacagaaagaataactaaaaccctgatttggtgattcagtgtcaaaggtgagaaatagctacggaaagcctctgagctatccagtctaagctttaaaagatgaataggcagcaggagaggtagggaacagttgttccagacagaatagcagcttaataaatcatggaggcagcggaaaggttggtgtctttaagccacaggaggtagttgggaatgactggatgaacaatgcattgaagagggtgaggcagagaagacagaaatgcaaagacccagacataaggggctcctcaaagcaaaggggtttggactgaaactttgaagcaatgaaatatttcaagcaagagaccaatataatcatgttttgcttctgtctcttttcattattaatctttgatttacatctgcactgtcccagatccctccattgactatagaaagatataattaaaactggacttcttggatgtgtgagtgtgcgtgtgcgtatgtgtgtgtgtgtctagatttttagcaccccgaaaatctaccatctcatcaagaatcaccatgtttttcctacattcacttaaagaaaaaagatacgcgttgtttttaaaaataaaatgcttagtatctctgacacatagtttaaacttccatttctaaccacataaaaggtagctcaatcccaataggtcctatatttagtttttaacacactggctcccgaaccatctaaggcaaatcatctcacctctctatgaatcactgtcatcatttataaacaaaggagagtaattctcaggtctcttagaccactgcagagaaaatacattttaataaagtgctgcaagtcttgtcaataaaagagaagagcttattataataaacttgttgcattacaactgtttgtaatctgtaaccttgtcttatttatgattagagaaacacaatgtgctgcataaacagtaatagttgctctaagcttttatggtgaactcaaagtaatattgtatcccaggtaagaagctgatagctttctgccatgaaattctaatcctgagggtctgcaagccatgtttcctttgtaatgtttccctcaaaataattttttcttttattttttgtcttttactctttttctttcctattataatgtataatagcagcagcttataataatatgttatgtgtatgaaaaattcttccaccaaactgtaaacttcatgagggcaaggatggtgcctatcttgtttattgctataaatccaacatttatcacagtgactagcacatagtaactgctcagtaaatgtctgttgaattactttttaaataataagtgaaatactaatcagttctaagtaaaagggtgcacacttcggcaggcattcatacaaagataaatctggggaaagtccaggaaccagaagatatcatgaattctccctttcaatcagagccatagggagcttttcaaatttttaggtttgttaatttatatgccaaccactttctctaatcgtagatgtgattatttatttatttatttatttgtataaactaatataaatgtttgctctttcctgtaaggttgctctcttacttaccttcatctcattttcttttcttcttttgactatgtttcttttatctttaccttgccttgaatttcatctgtaatttgtttcaatcatgataataatttatttttgcatagcattatatggttgtccatgagctttcaccctttttatcacatgtgaacctcacaataatcttctaagtggaggaatatgcatgctattaccctgatttcgcagagaaaaaggatgaagctcctaaaagtgaattacttaccataacgaggaagataaccagcagcaccgggaacagtcaagagctattctgactcctcaggtggtcctcttgactacacgtccccattcccaaaacatacaaacatgcacaccacaatgcaccactcaacaggtgtgcctaaaagaggaggtatgaagaatgtgagaagaaccatggcttgcaagaagcatgagaccaagctgagcggaaatggttcgaggtgtataaatgatattggccacaagcccaccttgtgctccctcttaaacactgaactatgcctgcagtctaaatagcgtactggtactagaaccaggtctttcctaccacagctacatttgatttcaggaaaaaatgcaataccttgcaaaaaaaaaaagaaaaaaaagagagagagagaatgaaatcaaatgtcaacagattaatctagctcaggctcataagtttcctttggtaataattttacttgaattttagttttgtattcttaagttattattttatttagtctatatagacagaagctaaaaattcaatttgcccacaattagcagtgaaggaaacaaagcaagccaactctcaatagaagacagatggccaatatgcatatgaaggaatatttcaacctagctggttataaaagaaatacagacacaacaatcataaaattgtgtttttcaccaatgaaattggaaaacacctttaaaataaagtatctgtcaaaggtatacgaaatgggaattcttaatcaaacacatctggtggaaatagataatttgaaaaaaaaagtaggtaaatagaaccattctgaaaaacagtatggcaatgatatgaaaggccttaaaaatactggaaattaacatttgcccctataattctaccaaataattaattctgtttctgaaataatcaaaaatatgcacaaagatttacatacagaggtgctctgttgccaaaattattgtagagaaaagtggaaaataacctcaatgcataataatataaaattttaaagtaacatagaagtgcaattatataataaatgctaagaaatattaaaagtaacactatcaaatatcctttaaaatataagataattatatatatatataatatatatgcacacacacaaaggcaagtttcagaacctatgcacaatatgattccagtaatgtaatgtaatgataaacaatgtatacaaaatattttgtagtaaaaaactagaataataagcgttttttaaagtttttccatatttcttaatggcatatttcttcatgttaatgtaattttgatcttcaaaagcctcaaagctaaaagaaagtaaaattaagttcaactctttaaaacaagaatactttatcagacaaattggtatagataaagtgacagattaaaaataaagcagcactggagagcaggcccacatattacagactcactgtcatgcaatattccccagcagggctggtgttgaaaatataataacagaaggctttggtgatacctcataaagcttgtgttccagtgacaaatagcaagggtaatcagttcagatttagcaacgaactcaaataaaagttaattaggaaaatggggactctttacagagtctaaatgtcaaacaaattaaagaataatgggtacactaacataaacaagaaccaggaaagaagcctcttggctggaccaactcccagtggagagggtacataagagccccagagaaaggagagatattcacacctcagaagccttatccttcttttcaatcaaacccataaataccacagactctaatagccatggattgctgtgcctctcgaggctgcagtgtccccaccgggcctgccaccaccatctgctcctctgacaaatcctgccgctgtggagtctgcctgcccagcacctgcccacacacagtttggttactggagcccacctgctgtgacaactgtcccccaccctgccacattcctcagccctgcgtgcccacctgcttcctgctcaactcctgccagccaactccaggcctggagaccctcaacctcaccaccttcactcagccctgctgtgagccctgcctcccaagaggctgctaatggatggctactttgctcagtgcctgagattgaaaaagtcaacatagaagctttagcattcacctatctcagtacctacaactaatgtactctgctttagaaattggaacaaggatggtactaccacaatcaccccctgcaaaaaaaaagagaccaagaaactttcaatgaccattcagctataaccaactgcagtttgaatcagtggatgcctatagcttcctgaagctgttcgattccttcatattaaagtgtctctttctgtgggtggtttgggaattctgttttcagtcttgggtggtatctttctgaaaattaaggaagttcttcatgattatcctaataaattttacatctctggcatagcacaagtgtctacaattacttctgtttatttctgttcattcattaaatgcgtttcttaactctgaacattggcatttaaagaaaaactggaaacattagtgaaactgaaaatggtggcagtatggacaaaaatttcttaattttgctgttcttgctgttttaagaaaattaaacatccttgcatgtaagatggtctagtacatcggcatatttgaaagtagacttttcctgacttgtcctcccaaaaaatggtttcagacaggttgagaaatactgaacattacccaaacaccaaatatgacaaaatatataaactaatccaggtgacatgatctatttatgaaaaaaatataataatgtcattatttattcaactaagatttattaaatgtctattgtgtgtcctgtgttttattgtctctgctgaaaataagctaaccatctggcaggtgaagcaaatacaaacacaacatccatttgtttcttcctacggttaataattatcgaatgccagttgctgtgttataataaaaaaagatgtgttctaccagcagtattagtaaagtgctgtgggatcataaaattgagaacaatgaagactgttgtcatgggggtaaagtgggaaagacatagtcaaagaggaattgactgcagctagtcatcaaagggatatggaggaaaagaaaatatcaaagaaagactagacagtggagttatgtcaccaattgagcctaggagccgagaaggagaagagagttcaagatggaaatactctgttcttcttgctctacacaggtcatgtttgcaacacgagtagctatatctaaatggggtttggaaagttattctggagaggaagaagatatacgtaggtaagtaaagaagactgtgtaaaagttctcaagtacttacagaaggcacagttgcaaatacgctggctgaaattccatcaggcatagcaaagagtggctgctgggtgattagaagctgagtggagataccagaggtcattcactattaacagactttgaggttccagcctagccagggtagaaaaaaggattgaaaaagaaattgaagaaactaagaagcctgtgggaaagtaccaagtggtgaaatgaggatgaaattggagtctcagaatgagaggagttaaagaataggaaataaaaatttgggagggaataaaagcaaaaattttcgaaatttggtgacattttattaacccatatattcaagagtctcaataaacacttagcaggataattgcaatacacacacacacacacacaccacctacacatatcatagtcaaactgctgaataccaattaagaaaaaaaaacaaatcaaatagaaggcagcaaagaaaaaatggatgtctgacttctttttaggtaaaatggatgtcagaggaaaatcaaacctcatttaaaaggtcctaaaggaaaaaaaattgtgaacactacagtctgcaaaaacaaccttcaaaattaaagaaaaaataaaaacacttttaggtgaataaagctgacttcttttttaagtgcctgaagatctacactataagaaacaataaggaagtccttttggtttaagagtaattttacctcaaagacaaaaaacaaacaaaccagttcagaaatggacagagaacttgaatagactttcttcaaagaagatatacaaatagccaatcagcacaggcaaaggtactcagcatcactcactaatcattagcaaagtgcaaatcaaaactacaatgagatactacctcccacccattaggatggctgccataaaataaataaataaataaataaataaatacaaaaaacaaaacagccaggtgtggtggcttatgcctataatcccagcactttgggaggccaaggcaggtggatcacttgaggtcaggaatttgagaccagcccagccaacatggtgaaatcccgtctctactaaaaatacaaaaattagctgggcgtggtggtgggctcctgtaatcccagctacttgggaggctgaagcaagagaatcacttgaacccaggaggcagaggctgcactgggccaagatggcaccactgcactacagcctgggtgacagagcaagattccgtctcaaaaaacaaaaaacaaaacaaaaccccttatatatatatacacacatatatatgtaaaatatataatatatacattatatatatatagagagagagagagagagaaattggaaccctcaagcattgctggtaggaaggtaaaattgtacagtgactgtgaaaaacaatatagcacttcctcaaaaaattaaatgtagaattgccttatgatcttgcgcttccacttctgggtatatacccaaaagaattgaaagcagggtcgctaaaagacatttgtatacttgcgttcatagcagcaataattgcaatagctaaaatatgaaaacaaacaagtgctcattgatagacggatggataatcaaaatatggtacatccatacaatggaatattattcagccctaaaagggaaggactttctgacacatgccacaacatgaattaaccttgaagatgttgtgctaagtgaagtaagccagcacaaaaagatactattcacttatatgctttcacttatatgaggtagttaaaagtagtaaaaaaatcatagagatgaaaagcagaacaatggttgccaggacacaagggcgggcttcatgggcagttgtttaaagggaacagagtttcagttttaaaaggtgaaaagagttatggagaaggacggtggtgatgcccacacaacatttgaatgtacttaataccactggattgtacacttaaaaatagttaaaatagtaaattttatgttacttgtattttgccacaataaaaaaattttaagagtaattatacaaaatgaagtctcagaccttcaggaaggaaaaaaacactgaaaatggtaaatacatggataaaatatgagactttctctttttccttttctcgatattctaaaagacaatgatttaaagcaaaagcaatggcattgtagggtttctatatgtagaagtaagcaatttgacaataatagcacaaagaacagaaaggggcaaaaagaaccctactgtggtaaggttctcgtattttacataaagtgctacagtattaattccaagtggagtacaaaaatgtaaagatgcatatcataatcctgagagaactaccccaccctttagaaaaaccattaaaagatatatacttataaagctagtatagaaaataaagtagaatgtttgattggcccaaaataagatgagaaataaaagggaaaggaagcaaaaaacacatggaaataaaaaacaaatagcaagatggtagattttaaaccaaccatatcaataattacattaaatataaagtaagcactccaataaaaagtcagaggatgtcagattggatttaaaaagaaaacccagcactatgctgttttaaagtgattcactttaaatataaaagcacaagaaaattgaattatgtagtctgaaaaaaagacataccacgcaaatagtaatgataagaaagaagtttggtcacttaaatattagataattttaaggtgatatttcataatgaaaaagggaaaattcatcaggtggtcctataatccttaaaaatatgacccaataacagagcttcaaaataaataaggcaaaaaatcacagaagtcaagagagaaatagatgaatccaaaatcacatttggtgattttaatatcccctgtcaggatctgagagaacaaacagataagaaaattaccaaggagaaagaagatttgaataatagtatcaaacaattttactcagttacatttacagaatgttaccccctacaattgcagaatatacattcttttcaaatgcataaggaactctcaccaaaatagactatattctgggccattaaatttgtctccataaattccaaaatctaacaaaatatgttatctgaccacaatggaattaaatgagaaatcaatcagatacttagaaaaatcaccaaatatttgaaaatcaaacaacacagttctaataacctatggatcaaataataaataccaatacagcttaagaaatattatgagctgaatgataatgaaaacaaaagattttaaaaatttatgggatacatacagcattggattagtagaaaatatacagcaaatgattatattagaaaataagatttacatctttatcaccttcatttatctcttcatcaatcacttaagttttcatttcaactaaatagaaaaagaacaattaaaattcaaagtaaggagaaagaaataaataataaacataatatcagaaatcaatgaatagaaaacgaggaaattaatgaagctaaaatttgattctttgaaaggattcataaagtacttctatttagttattttttagttggcaaataataattgtgtatatgtatatttgtggggtacaatgtggtgttttgatttatgtatgcattgtggaaagataaatcaagctaagtaacatatccatcacctaagcacctgatcattgttttatggtgagaacatcaaaaatctactctttcagcaaccttgaaataaacaatacattagtattaatctgatgaacatcaagccagattgatgggggaagcatgagataaaacacaaattaccaatatctggaattaaatagtgagaatttatagacactgcagatactaaaattcatgataaggattattatgaacaactttatttcagtatttttgcaacttaggtgaagtgaacaaactccttgaaaaatgcaactttcacacaaaatgaaatagaacaactgaatagcattgtgaggtttctataagtagaggtaagcaatttgatgtagaggtcagcaaatatacatatatttgcgtgtgtgtgtgcatgtgtgtgtgtgtgtgtgtgtgtgtgtgtgtgtgtgtgtgtgtgtttgaaatggagtctcactctcacccaagctggagtgcaatggtgtgatctcggctcaccgcaacatctgccttccaggtttcagcaattctcatgcctcagcctcccgaaaagctaggactacaggtgttcgccactatgcccaactaatttttgtatttttagtagagacaagccttcagcatattagccaggctggtctcaacctcctgcccttaagtgatctgcctgcctgggcctcccaaagtgctgggattacaggcttgagccaccgcgcccagacattttttttcctagttaaaaacaaaacacaactttttcacatgggagactcctggaagaggtggcctcactggactccatcaaacatttaaggaataaataacactaatcttacagaatttcatgaaataaagaggaaacatttcccaatttaatttatgaacagtattactccattctcacactgttataaagaaatatctgagactggataatttataaaggaaggaggtgtaattgagtcccagttccacatggctggggaggcctcaggaaacttacaataatggtggaaggggaagcaggcacttcttacatgggggcaggtgagagagagcgtgggaaggaggaactgtcacacacttacaaaaccattagatttcctgagaacgaactcactatcacaagaacagtatacgggaaactgcccccatgatccaatcatccaggtccctcccctaacacgtggggatttggggtttataatttgagatgaagtttgggtggggacgcagagctaagtcatattgtgaacccagtatgtaacttgataccaaaacctaacaagatcattagaagaaaagaaatttacaggaaatatttctcaagaacatagatgggggtggaaatccatttgctaatcctatcaactaactgaataaaacaatttacataaaggataatgtagagtgaccaagttattcaatatgattgatcatgttgtagggtcacccagatcatccctccacttccttctttgccttgggaaacagattaccttgaccaccctgtggcccagccagctgtgtgtttcccctgcagcttgaacccgagctgacccttgaacattcccaggcactgttaaaagttatttaggttgttgcccaaaacagtgaaaatcaaccaagttgctgcacgtggatactagctctggccctgagccaaatttcttaaggcctcatgtaaactcttataacctgtcgcacaaatgttaaaagcaacaagacaactgctatagcagagatgcgtgcaaagtgctctgggaggagccacatctccacatgaggcagttgaacgacgtttcagctgagtcttgacatgtgagttcatccaggaaacgaatagcagaagagcatttgaccaagaaaatagtacctacgaagcttgaaggatggctggagcttagggtttgtgagacagaacatcaggaagtgagcccagaaaggtaaattggcaccaggttagggaaggtcatatttgccaaggtagaaagtttgcattccataagtggaaggcgacaaaaagcaggtttgtattttaggaaaatgattctggcagcctaggtggatgttgtaaggtaagagcatagtattatgcaaaataaactaccgtgttgttgtcggtttttttttttatcatggcctttcatgatgtctatttctttttctctattcccaatgttcctttcttctggtgatgatatgctatagaaattgtcacgggtgattagcaactatctggggctggtggcatgggggtaagaagaatttatcaagatagttgtaggtaaagaaaggcagatatattagagaacgtatgaaaatacgttgcaaggaagcaatgggcagcacagcagagaaggggctgtctgcaaggagacaaaggcgtgctggagattttacaggatggtgcttgtactgtgtgctgaagagggtttgtgtggtactgataacactaaggttgcagtgagctaagttacatttttctatcagctgaaggtctggtgatagctgggtgcaggaatattgtgcaggagggctatgtgtcctggaccatgaagaaggtgagtcttatacattacctgctttctttctttgttttttgttttttggttttttttatttatttatcacattgtgcaggttagttatatatgtatacatgtgccatactggtgcgctgcacccactaacttgctttcctctggtcctgccagcctgacttcttttccctaaggaggactccacagaaatgaattctgggtgatttctatattctacgatggagactatagctatagatcattatacaacactacctaattaatcaagaccaaaataaatagtcctacctgcaggacaataaccagtaacaaataatttacaattagaaattagttccagacagaaggaaatatttcttattttacctgcacttacatgactgcattttagctaactggagcctgtgatggacaaccaaaacatgggttttcttcacagatatttttcttttgactcattaggttactgtgaaaagataattttctttcagagatttgtaatttttcagaagtgtttttgaatccttgaactcatatttgttgcagagcagcgtcaatataccatgagacactctaagaactttttgcataagtgttgatgtgtaaagagaatcactaaattcaaacccagctctgcccagggagtaataaatcctaagagactattttaactcacttacatatgttcttctggtttggtttggtttggtttctactatcaggtacctaggaagtagcactcaagattaggagaaaaaataagtttattctggatcaaaaattttttaactttttcagattaatctgtttttttcctataatgttcttaaaaattctagagacaattttctctatgcacctttgaaaatgaaataaatgtaacgactaaaaccaagcaaagtgaaatagattatccttcacaatggaggtgaaatccaagagataattcaaaaaaattacgtatctcaagttcctgtctgtcagatttggcaccagagatttcatccagtggaattactgatttggaacctaaatagaattttattttccaagttccagtattttcaattttcatgaaattcaggccttcataaataaataaataggagaaaacaggctctacatctcagaagaaaagattcctgtgggttccttgcccctactctgaagtataatcattaaggaattcccaagggactaaaaggttataacttagaatttatatttcactcttattaggaatacaggtaaaatagtataacttatctaacaataagcaatgagaaatgtggagaaggcaagtttcaggaaatcaaagatcataattccagctctaaccaatttatattttagcctgcagaaaaacaagttattcctatcagttatgtaaagtgacttttccatttgtacgcaggtagacatggtttgcacacacacacacactttaaacccaatatatagctcactcctccagtctttatcagcacatgctctgagatcacaaaaagcattgaaagattactaatcacactgaccatttttatggtggtggcacaaacaaataattgtcattttgtgagctgtaatactaattttaaaaggggacacaagcaatcaatccacagaatcaaaatctgtggacatattattttcctgatttgtaatgagttgtatctataattattcattggccaaattttctctttcttttattattctgtcaaaagcacaatgcttcctatgacgattttctgaaataagtgttttgtcttgcacatggaaatggtgtgggtcctgctttggtaacctaaagttatccctattttatgaggcataaaactcttcctcagtaaataaacaactctaatgagatgtttgtacgaaaactggcaccatcagtgataaagaaaacatccggtgcagtctgtaaacacccattttggggggttataaaactctcaggagaggagagttttggagtcaaggcaactgaagttttgcagccagtctctgtctttgcttctggaaggatgacttctgactgctcctccacacactgctctcctgagtcctgtggcacggcttccggttgtgcacctgcctcaagctgctccgtggaaacagcttgtctccccggtacctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccagctatctggagaaggtgcgcagcctggaggagaccaacgcagagctggaatccaggatccaagaacaatgtgaacaggatatcccaatggtgtgcccggattatcagcgttacttcaacaccattgaagatctccaacaaaaggtctgtgtcctgttgccctagtgctccaccttcctgatctatggtttgctttatctttctactagaaggggctgttttacagaaggaaaccaagggaaaggaaaattctaagagttagtgatacataggggagagcaccggactgaaagtcagaaaacctcagcatcagccccagagctacccctgattactgagtgactataataaagtaacttgcctgtagacttttccttcatcatctatagaatgcagaaaaactgtattatatccaaaatcgcttttgtacgtgacactgaacatttacattatctgaacacagatcatgaaatgccatctttttaactacctagtaatcattttcttctctccatgaatttctattattatgggagaggatatactcataatacaaactactgatggagaaaacattaatggtgttcaactgcctgagaatgttgcaaaatgtcttatgttattaaaaaactaaacctttttatttcattattttgtttctaaattggctctgctttttttcttcatgaagtgacaaggttaataaaaaaaagcaggctgagggtgattttatactttcttataaagactttcaaaagatagctaatggcatagctgttggatagaagtttacttaggtttctctcaaagaatcatttatcacataatgacttgcttcccagatcttatgcacgaaagcagagaattctagacttgctgtacagcttgacaactgcaaactggccactgatgactttaagtcaaagtaagtttaatttaattttattttatttatttattttgagatggagtttcactcttgtcacccaggctagagctcaatggtgctatctcagctcactgcaacctctgcctcctgggttcaagtggttctcctgcctcagcctcctgagtagccgggattacaggcaggcgtgcaccgccacacctagctaatttttgtatttttagtagagacagggtttcaccatgtgggccaggttggtctcgaactcctgacctcaggtgatctgcccgccttggcctcccaaagtgctgggattacaggcatgagccaccacgcccggctttaattttaatttgaaaataacttatggctctctctctctcaatctctctctctcacacacacacacacacacaaatattctctatataatattttaaagttaagaatgttttaaaagcttgaatttatcattacttaggaattaagagaaattatgcacatggcttcctgaagtccgtgtgtcgatcctccatgtatccccacactttgcacagcgttcagcaaagtaagcgttggatttctcttttgctgtgaaaggtacgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagaggtaaggaaagtggcaactccgctgaaggactccgagagtaacgtacttacattgacagatgatctgttgatgtttgtaaatcgaatttgggcagatgttgtttaagctggaataaaactacttgaggcagggccaggcatggtggctcacacctgtaatccaagcactttgggaggctgaggcaggaggatcacaaggtcaggagttcgagaccagcctgaccaatatgatgaaacctcatctctactaaaaatacaaaaattagctgggcatggtggcaggcgcctgtagtcctagctactcgggaggctgaggcaggagaatcacttgaactcaggaggcggaggttgcagtgagccgagatcttaccactgcactccagcctgggtgacagggcgagactccatctcaaaaaacaaacaaacaaacaaacaaacaaaaactactcgaggcattattactattcaacctgatcattccagtgtgtctctgatttaaggtgtgaaataacccctagacagcgccagaggaaggaatcaaactcttctcctgcccttgcctttgtggaggaggtaacttcacaaatggcttcctttggaggctttatgccacccctagctccagtccacagggtatgaaaatcaggctgaggaacagactgtgaagtccatttcaaaaaagggataaagactgtgcactatctggaccagtgtttttaaatattccgcatttataaacttctaaaaatcataaaatatacagccactgatatattgataaagctagaaaatgaaaagctgaatgatgtaacaaagtacatttgctctttgaacgtttgttgatgacaatcatagctaacatttattgacaccttactatgtgtcataattaacttttataagttaattatgtgtagattgactcttctagatctcacaataactttctggaaaaatgtccaattattatgtccattttacagacgaagaaactgaggcccttctaagtggtgaaaagagattcagcccaggcaatctgaatcaaaatctcacacttttacccactgctccaaaaaacagaagtagaatgccattggatgtcaaatggatttttccccaccattctgtgacattctttacaccatcccactttcaggaagtcaacttgcttcgtgaacagcttggcgaccgcctcagtgtggagctggacactgcccccacccttgacctcaacagggtcctggatgagatgcgctgtcagtgtgaaacggtgcttgccaacaatcgcagagaagctgaagaatggttggctgttcaggtcagtacccagattgaaaaaatgtcaggcttacagacttctgccttttttgaattctctaatggtgtctgtgtttcagacagaagagctgaatcagcagcaactgtccagcgcggagcagctgcagggctgccagatggagatcttggaactgaaacgcacagccagtgctctggaaattgagctccaagcacagcaaagcctggtgcgtgaggcaaaggcagtgtccgttgtgtcactgataagtcaggccctgagatgttaagccctcttccatatccgaggatcacatttccttgcctttcccgagtactgccgtttacccagctattaatagaagcagaagtgacaggtccacagcttgtcctctaagatgccttaccttcactcctgggcttgagtctgatgctgcagcagcctccagagacagggagggagaagcagagctggagagaaacctccgggccatggtcgcttaagcattctggcaggttttaattctcatttgattcaggccagttttccaggctcactgttatatctaaaacaaagaatcattttcaaacatttcatcctacagtttcccaggatctacacttcaaccttatccttcactgcaccaccccccactcaagcaacaggaacaccatgcgttcaagatgacatgaaccagttctggtcaagcaccactgtgtgcatgtcattaggccctgcggagaacacctagaagaacaatagctgagcattcatcctgtgagaggcactatgctgatttaaggctcacagtaactttaccggatagatacctttatcccatgacacagataaggaaaactgagactcagattaagtaacttgcaaaggatgcaattctaagaggcaaacttggaagctgagttcagccagttgaatcccagagtctcttctctctctctttttaaatttatttttattgatatataatatgcgtaaattttttttacgtagatgtgatattttgttacatgcatagaatgtgtaatgatcaagtcaggatatttagagcatccatcacctcaagtatttatcatttctatgtgttgggagcatttcaagtcctcccatctagctattttgaaatgcacagtgtattgttgttaactgtagtcacacttctctgctgtccaacatgaaaacatattctttctgtctaactgtatgtttgcacccattaaccaacctctcttcatccccttaccacacatatgccagtcccagcctctggtatccagagcctcttctcttaatagcactatactacccctccctgccaagagcccaaactcaatctttcctctcatatgttgtggatagtccttaagcttcacaaatatgtcatgtattgctgtagtcatagtggtggtagtgatagttgacacgtagaacagtggcagtatggctggcactgttctaaatgctttacgcacattaactctttttttttttttttggacggagtctccctctgtcgcccaggctggagtgcaatggcatgatcttgacttactgcaagctttgcctcccgggttcacaccattctcctgagtagctgggactacaggcgtccaccaccgtacccagctaattttttatatttttagtagagacggggtttcaccgtgttagccaggatggtctcgatcttctgaccttgtgatccgcccgcctcggcctcccaaagtgctgggattacaggcctgagccaccgcgcccagcccgcatattaactcttaatcttcacaaccgtctaatgaaacagatactttgtattctccactatacagagaataaaactgagactcacagaagctaaataatttgccagtggtcacatagctagaaaagggtaagcaggaatttgaaagtaggcactctggcccgagagactgcacttcatggtcctttggacaatgtttcctcccgcagacagaatctctggaatgcaccgtggcagaaaccgaggcccagtacagctcccagctggcccaaattcagtgtctgatcgataacctggagaaccagctggccgagatccgctgcgacctggagcgacagaaccaggagtaccaggtgctcctggacgtgaaggcccggctggagggtgagatcaacacgtactggggcctgctggacagcgaggacagcaggcaagttccacagttactcatgaaatcccccagagtcacaaagaggctgatgtaaaagaatcctgtttccccaaagtctggacaagttcagacctccccagtgtgtttagggatcttcttaaaaaagtgctgaaaagtggctgaggttaagaacatgacactagagatatttttaaaatattctaaaggcagattaattattagtgtaacatttcatgctggcatctccctttgttcctgttttccactaaaggaaaatcaggaataggcctaagataacatttgcaaaatcaagaaaaaatataaaatactattcaactgccactgctacagtgaacatgaagtggcaattctgggtgcagagaagaaacaggcttcagtcaatgctattgtgcagagtttttttcagaacataatttgtagggcaaattttgacacggtttttctgagttgccattttatcaacattcccttgttaatcttggttgaaaatcgatttttccccaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagctctatggctgattactgttgatagaatattcattttatggcaaggaaatcatctaaacccataaccatagtttcaatgtacataaacccaggctgaaaatattttttaactcctcaaatacaaataaattaatgaacccatgagaaatgtcatatatcttagaaaatagttgtgtgtatctttctgaggaaaaatattaggaataaaatatgataaaatgtattttttgattataaaagtactagattctctttttttaaatttggctcattaaaagggaaaaggtcacttatgatttcatcttccaaacagccatagtcaatattttggggtactttcttccagttttctttcttataatagatttttccacacagctataatcatactaacatatgcacacacttgtgtaaactttctttcatttatgtcatctaagcatttttaattctaataaaaacataagattgtattgtagccatcactttttttattttttattttttttttgagacagagtcttgctgtgtcacccaggctggagtgtagtcacactatctgggctcactgcaacctctgcctcctgggttcaagcgattctcctgcctcagcctcccaagtagctgggactacaggtgtctgccaccacaccaggctaatttttttttttttttagtagagacagggtttcaccgtgttagccaggatggtctcaatctcttgaccttgtgatccaccagcttcagcctcccaaagtgctgggattacaggtgtgagccactgcacccagcctgtagccatcattttactggttgcataatgtaccataaggtacattgatctgttattggacatttaggttataagaataattattctcatatatttaaaaaacaaggtagagaacttccagaatgatgtatatttccatattcctcctcctaaaaaccctggaaattacatatcaaataaacataagaggactctgaaaggtagaagaagaagccaaaccacctaaagatgttgagactccaggagtgacactgtggtgagctccctggattagctttttatctcatatatcccagagggggagctggagaaaccaacaaccagaaacaccaacaggtgcagacaaaacaaacaaacaaacaaacagaaagagcttgctctgcttaaagaaccagaaaagaggcagcctagaaaggcggaaaacctttagacaataaccactcaactcagccaaacaccacagaaaatatcatttcacccacccatatccacacaaggaaaggccaggtggggagtccagacttctatccttcccaggctgtaataaggcactcaaacttcaccactggggtggaatcagggaaggctaagtgagagatccaggactttcattcctactatgagacatggaagcactccctgtcccaccatcatggtatcagtggagaccacacgggaagcctggacttaactctacaggctgcagtgaggctcttcttttctcctctggggttagtgtcacaagagtcctactggacagtcagaactctttccctcctccagcagtaccaaggccacccccatgcagtgtcagtggaagctgcatgggagcaataacaagatattcctgcccctcctggccagggtggtatcagcagaggccaggtaaggagtctaaaatcctccctcccagcagtgatgaggggggctctccccttgggtgtcaataggggcaaagtggagagaacctgtatttctactcccacctggtaggaatgaagcagtgtcccccttcccctgccaaaacagtgtcagaggagacctgctagaacataagattaaacagtatcctgaatctcataacataatgccccaatgtccaggtttcaatcaacaattgctctttataccaaggatcataaaatctcaacttacaggaaaaaagatgatcaacaaattcaaacatcaagaggaaaaagacgttagaattaactgacaagggtttttaactttttatttgttatttttctgggtacatagatgtatatatttatggggtacatgagatgatttgacacaggcatgcaatgtgtaataatcacatggagaatggggtgtccatcccctcaagcatgtatctttggtgttacaaacatccagttacactattttacttattgacaatgatttttaaatagtcatcataaaaatgcttcagtaagcaatgcttcaataaactcttacaacaaatgcaaaaatagagaagactcaatgaagaagatggaaagactccagtggaaatttcagaactgaaacataccatagaaccaaaatagaaacctcaatggagatgggcttaacagcagaatgcaggccagagaggaaaacatcagggaatttgatgatacaataatagacatcatccgacctgaaaaacggaaaaaaaatagtgttaaaaagatagagtctcagggaattttggggctatatcaaacgatctaacattcatgtcagtggagttctgtaagggaggagaaaaagtgaagccaaaaacatttgaaggaataaacactgaaaatttacaaatatggcaaaagacaaaaacctacagattccagaaaccaagcaaaccccaaaaatgataaaccctaagaaatctacaccaggaaatatcatattcaaacttttgaaagctaaagacaaaaaaaattatgaaagcagtgagagagaaatgacaccttaccaatagaagaaaacaatttaattgatggcaggtatgtcaccataaaccatggaagccaatatgaagtaatacaatagttttcaaatgctaaaagaaaaaaaaaaactgtcggccaggcgtggtgactcacacctgtaatcccagcactttgggaggccaaggaggatggattacaaggtcaagagatcgagaccatcctggccaacatggtgaaaccccatctctactgaaaatacaaaaatttgctgggtgcggtggcgggcacctgtaatcccagctactcgggagactgaggcaggagaattgcttgaacccgggaggcggaggttgcagtgagcagagatcgtgccactgcactccagcctgggtgacagagcaagacaaaaaagaaaaaggaaggaagggagggagagagggagggagggaaggaaaggaaagagaaacaaagagagagagagaaagaaagaaagagaaagaagagaagagaaggaaggaaggaaagaaagaaggaaaaagaaaagagaaaagaaaagaagaaaagaaaggagggagggagggacggaacgaaggaaggagggagggagggaggaagggaaggaaggaaggaaaagaagaaggaaaggaaggaaggaatgaaggaagggagggagggaaggaaggaaggaaaagaagaaggaaaggaaggaaggaagaaagaaagaaagaaagaaagagagaaagaaactgtcaacccagatttatataccctttgaaaatatcgttcagaaaaccaaagagaaatcaagacattctcagatgaaggaaacttaaaagatgtggccagcaaaccaacctaaaacaatgactaaagaaaattccctaaacacaaacaaaactataaaataaggaaacttggaagatcagacaggaaaaaatataataaaaaattaatatatgattaatttaaataaatttctttctcctcctgagttttctaaattatgtttcatggttgaggcaagaagtataacactgtctgatgtggttctcaatatatgtgtagaaaatatttaagacaattatattaaaatggaggcgagtaaaggaatataaacaaaggcgagttttccacacttcacttaaactgataaaacgttaacactggtagactatggtaagctatgcatacagcatgaaatacccagagcaactatttaaaaagctatgccaataggtatactaaaaaacactatagataaatcaaaatggaactctaaagcatattcaagtaacccacagaaaggcaggaaaaagaatacagagaaacaaacaaaaaacagaatgaacaaacagaatacaataaatacaatacaggctaaatatagaaaattacagcaagtggaaagagtctaaagacatagaaaaaagacagatcttggcagagtggataaaaaagcatgatccaactgtacgatacattctgcaaaaagctaaatataacaatataggtaggttgaaagtaaaaggattgaagagatgcacaattgttcatagcagctttgtttgtaatagccaaaaactagagatcacagaaatgtcctaaagatctcaaggccatcatgccgagtgaaaaagggcaattcaaagggccatatatttgataattctatgtatataacattcttgaaatgacacaattataagaatggagaacaaattaggcataggacaaaggaaagctctgtggtgattgaatagttccatattttgattgcaccacccatgtgaagaaaacatatatgtggccaggtgcggtggcacacacctctaaccccagcactttgggaggctgaggcaggcagatcatgaggtcaggagtttgagaccagcctggccaacatggtgaaaccccgtctccactaaaaatacaaaaattaaccaggcatagtggtgcacgcatgtaatcccagctacttgggaggctgaggcaggagaattgcttgaacccaggaggtggaggttgcagtaagctgagatcgcgccactgcactccagcctgggcgacagagtgagactccgtctcaaaaaaaaaaaaaaaaaagtgcccacgattcagaaatctaatatttacaatattagatttaatattttaaatatttaatctatgtaaatttaatatttacaattcatggattcctcactggctctacagaggcagataaggccttcctatcactcagctactggtctcaggctggccccagtgcccattcttcctatgttgtgcacaacccctttctcagaaagacaggggcaaagctgtcaagagaactttctatcacttccagattcgatcttccaggcagtgtggacttgagtttttacagctgagattctccaaaatgacactcaaaaaaagaaaagagaagagagaagcacttctagaacagctgccttctcagtgcctggggcagggaagagacagcccaaagatcttgaaccagaaaacaaagccttggtaataccctgcctaactgcaaaggggcaagagagggtaagcctcccatgtgcccaaaaggagaggagaaccagatatgcgtgagcccgagtctcttccagaacagccttgaaacacacagatgaagaaaggtagagggaacccccacaataaatgtgcagtgggggaacagggcaggaagagcttggggaatagcaaaggatgcagttgggctagaatgtatagagtgggtcgggggtcctggaatatgagataaagtcagctgggtcaatattgtggagggtcttggttgccaggcaaacaagaatttgagccttgctctgtctgtaggaaggttgaacatttctgcaccagcaatggagctatatgaaggtagataaagaagatctccaaagtggagaatgtggtaaagtaatttacaggctagccagattgacaaaagttaacaaatgacctggtggtagaaaaataaagacaataagtacccactattctgtcaaaaggtttggtaatgaaaagaaggcagaagccaccttcatggaagaagtgcctcatggttacgggtcagacattgtaggatcagttaacagatgtgcttatagggaaagaaaaaatgatccagtagtaaagaagacatgaaagaggcaagaaaagggggagcataatggatgaaatgtggccctgaagaaatcaaaagggaatcagccaaggaaggaacaactctgcatgtgagacacaagaggaaaagaataaaaattattagaaaggtatggaggcagaaaaaaagtctaagaaactaacgaagcagaaacagttttgcagacaatttttctaatgattctaaaagagatacattcaatttgtggaatttgtggaataaaaacaagaaaataatattcatcagtaactataaaatgcaaagaatttcactgctaacctcttgatttatttactttcagtatttttcatacattttcaaactaatggactatttcaaacactgctattttatgaagtcaaatttatcgtattttttacaggttcttaatttcaagtcactgttacaaaggccttcctcatctgaatttgtaaaagtattctcctatattttattttagtacatttatgattttcacttttcacatttgaatctttgatccatttgtaatttaagtatatagataaagtagtgaacattcatgcagctgcacagttgtatcaaatcttaactttttatgttaactccactttattgagatacaattttcagacaataagatgcatcaattgaaagtgcgcaggtcaggctgggcacagtggctcacgcttgtaatcccagtgctttgggaggccaaggtgggaggatcagttgaggttaggagtttatgccagcctgggcaacataatgaggccccatctctaaaaaaatttttttaaattagccaggcatggtggcatgtgcctgtagtcccagctacttgggaagctgaggtgggaagacaacttgagcccagtaattcaaggcttcagtgagctatgatcatgctactaaactccagcctgggcaatagagtgagaccctgtgtctaaaaataaaaataaaagtaggcagcttcatggagtttgaaagcacatgaatttgtgtaatcaacacccagatcaagatacagaatagcatttcaaaatgtagaacatcaaccttagaaattctttcttgttgctttccagccagtacatctctctgacagagacaaccactactcttatctctaaccatgtcaaagatgagttttgcctgttcttgaagttaatataaatgtagtcatactgttcgtactgttttgtgcctgacttcttcagctcaatatgtttttgagatttttccatggtgtcatgagtaccggcagttcattctttattgttgttgcatactactccattacataaacatgtcacagtttgttgtccattattctgtttatgagcagttatttttattttagtgctattaagaatatagctgctataagcattcttgtgcaaatattattgtgtgtataaaatatatacattcatctctcttggacatatacctaaccatgaaattgctaggtccttgggggaggtcctttgtcagagagagagagagagagagagagagatagtatattactgtataaataaatatgtgtttatttatttttatacacatatttatttatagagtcatgtgccacataatgacatttcagtcaacaatgatggaacatacacatacaaaagctgtcccaaaaaactataatgtcatatttttattgtaccttttctatgtttaaatgtgtttccagataacaaatacttaccattgtgttacagttgcctactgtattcagtacagtaacatgctgtgcaggtttacagcctatgagcaatagactataccatatagcctaagtgtgttataggctataccatccaggttcatgaagtccactgtgatgtttacacaacaacaaaatcactaaaggtgaatttctcagaatatattcccattgttacaaaagatatgacgttgtgtatgtatgtgttctaatgtgtgcgttggggggtgggtgtatgaagagagagagagaatattttaacccaggctgtagcttgccttttcactttcttagctatttatctgatcaacaaaaggttttcattttgatgaagtctaatctatttattatagtgtcctccatgagcttagaagtcttctcatggcagaaggttatgaatataatcttctgagttttcttctaaaaactttagacttgaaatcttcacaattaagtgtttaatccaacctgaattaagttttatacgtagcgtgaggtagagatcaagatgtattcattttggctatacaagtatccacttgattcagcgacaagtattgaacagtattgaaaaaacagtattgaaaaagctttccttttctcattgacttgctttgggatctttgtcagaaatcaattgaccacatatatgtgagtctatttctaaactctatattctttctcattgatctactttccaacccttatgccaatatcacactgttttaattgtagtagcattatagtaacttgcatgaatttacatttcattgccacaagcaatgagagtgctataggcagtgaatgtatctgttatcaaactttgatttttttcagtttgataggtggaaaactaaaatatctcagtataatttaaatttacatttctcttttcatgagtgacattgagcattttttcttattttaagtgccttttgtattttccttttggtcactgtctagagtgtaattgtaatattgtttcccagtttgtcatcttgtcttctggttttacaggttgtatttttcacccaagcacaagttcaaacactgttattttatggagtcaaatctaacagttttttacggcttcttaattttgagtcatcattggaaaagtcttctgactccaaatttataaaataattatccttttgggcatatttattatttatttttcatatctcaatctttgatctacttgtaattcgtcccactgtaaaggatgaagtatggtttcaacattccctgcccccacaccaaagggaatacaaaattgtccccaaagtacatataatacatataacggtctaccttttccccatggcttttattttgtattttattttattttattaaaaatgaaatcgcactgtgttgcccacctgaacttgaactcctgggttcaagtaattcttctgcctcagcctcctacagaatgggagaaaatttttgcaatctgtccatctgacaaagggctaatatacagaatctacaaggaacttaaacaaatttacaagaaaaaacaaacaaccccatcaaaaaaatgggctaaggatatagaaagacacttctcaaaagaagacatttatgtggccaacaaacatatgaaaaaagctcatcatcactggtcactagagaaatgcaaatcaaaccacaatgagataccatctcacaccagttagaatgacaatcattaaaaagtcaggaaacaacagatgctggagaggatggagagaaattggaacacttttacacagttggtgggagtgtaaattagttcaaccaatgcagaagacagtgtggcaatttcttaaggatcaagaaccataaatacagtttgacccagcaatcctattacttgatacatacccaaaggattataaatcattctactataaagacacatgcacatgtatgtttattgcagcactattcacaatagcaaagacatggaaccaacccaaatgcccatcaatgatggactggataaagaaaatgtggcacatatacaccatggaatactatacagccataataaaggattagttcatgtcctttgcagggacatgaataaagctggaaaccatcattctcagcaaactcacacaggaacagaaaaccaaacactgcatgttctcactcataagtgggagttgaacaatgagcacacatggacacagggaggggaacatcacaccggggactgtgagggggtgaggggctaggggtgggatagcattaggagaaatacctaatgtagatgacaggttgatgggtacagcaaaccaccatggcacttgtatacctatgtagcaaacctgcacgttctgcacatgtatcccagaactcaaagtacaaaaaatctcataattcaagaaaaaaaaaaaaggatgaaaaggggccactagctgaggatgtggacagcctgtagaagctggaaaaggcaagaaaatgatgttcccctagagcctccataaaggattagcagcaagtaactttctgaagaaaatgctgagtaagtattcctcagaaagaaaacacacccctttcaatgaatcctatttaaacatccagtataaaccaacactgtgatacatttttatctaatgtaataccacaagcaaacaccaagcactaaaaatgttataaaatgtggactttggaaaaccaaaagagagctagtctcttttccaagaaatttcttattagcaatcaaaccctaccttttccccatggcttttattttatttcatattttatttatattttattttatgttattacattttatggaaagctaaaacataaatctagcaattatctttaaaacaagacttttaaaagactaacattttaattcatactcacattgtcctgacactgaaaatggggaaaccatttgggcagaacaaactaaaatattgacttctgatttctaagtttaccaataattattaaacattaatagtttcccttttctagagaagaaaggaaaagaaggatgaactcattcctggttaagctcagtgccaagtggagaggtcaacaagaatgtaatgaacttagtatactcacacctgcttaataatggatgctgttaggacagttccttttgaagacataatttgaagctctgggtccaatagacaagtagtagttatgatgggtaataacttactaacagcctaaatgcacatgtttatgagacaaataactcttcttaagcaagtaaaaagcagactaataagatgttcctacaggatttgatataaacctgagaaaggaaaacatcccacctgtgtgacaccacgtagaagagaggctatataagcacttcaaagaggaaaacaccaagagccttggaattcagactctgtggaggtggcttgagcttttcatcctggtgaccacagacctggaacaaactaaagccagacacatactatggacaccaagggctgtacaacaaccaattctccttcaaccccatgtcaaaactgctctaggattacaaatgttagtaccatctcttctaacaacggctgccatcctggtggccttacagtcaacaactgtcaaccagctggccacgttctcagaattccctgggaccagggctgccaacccactcctcgcttttgtcgcaagcccatctacctaatgaacaacttcaatgcccgtttttctctggatgactgcagctggtatggtgaaggcatcaacagtaatgagaaggagaccatgcaaatcttgaacgagcgccttgctaactacctgcaaaaggtgcgaatgctagaacgagagaatgctgaactggaatctaaaatccaggaagaaagtaacaaagagctccctgttctatgtcctgattacctgtcttactacactaccattgaggagctccagcagaaggtaagattcctaagaacctgtttaatcgtgttgtgaattaatggtttccaagcaacagttatttgctaaactttaatattttttgttcagttgatgctgaaaatttttttgaagaatagaaaaatttcttgagtgaaattgtcatcttgaggcagcattcagagtctgatagtatttctggtcaggcgcagtgatgcacacctgtaatcctaacactttgggaggctgaggcagacagatcacttgagcccaggagttctagaccatcctgggcaacatgatgaaattccatccttacacacacacacacacacacacacatacacacacaaaaaaaaattagatgggcgtggtggcacatgcctgtggtcccagctacttgggaggctgaggtgggaggatcacttgagcccaagaggttgaggctgccatgagccaagatcctgccactgcactccagcccagacaaaagtgagactatgtctttaaaaatcagaaacaaaaagaagagtctcatggtgtttcctttctccagaaatacactctaccattataactagatgactcaggaccaaaagatgttaacagcaagttgttgccattttttaaataaaaatagggaaacagagatcagagaaaataaattttgctttaatgagtttctaagcaatttagtttttatccatttttcaaccatcaccacctttttctccttttatgcttatgttatcatctccacattgcttggtttgtttctacaccaaacctaagtttgttatgcacagacgtattctgctactacatatctggatttattcagttttattcattcaacaaatgtttactgagcagcaacaacattgggccaaacattgttctagattctgggaaaatattggtgacctttaaaaagtccctgccctcatggagttgacattctagtggatcatggtatttatataaatttaggatggattttattttattttttatttatttatttatgtatttattgagatggagtctcactctgtcaccaggctggagtgcaatggcgcgatctctgctcactgcaacctccagctcccaggttcaagcgattctccctcctctgcctctctagtagctgggtctacaggcacgcaccaccacacccagataatttttgtatttttttttttttttgagacggagtctcgctctgtctcccaggctgcagtgcagtggcgcgatctcggctcactgctagctccgcttcctgggttcatgccattctcctgcctcagcctcccaagtagctgggactacaggcgcccgccaccacgcccagctaattttttttttttttatatttttagtagagacggggtttcaccgtgttagccaggatggtcttgatctcctgacctcgtgatctacccgcctcggcctcccaaagtgctgggattacaggcgtgagccactgcgcccggccaatttttgtattttttagtagagacagggtttcaccatgttggccaggatggtcttgatctcttgacctcgtgatccgcccgcctcagcctcccaagtgctgatattacatgggtgagccactgctctcagcctggattttttaacaacaacaacaaaaaaaatacttaaaagtttctagttaagtactttttgctgatcttttaggaaaataacaggaaatctgactttctgaagttttccaagctttgtgagcatagctatgaagattaataaaaagtctacttagccttcccctgttacttgacacacacacaaaccccttggttcttaaagaaggaaatcttggtgtttgcttcatttgtgtgtacaatctcttaattctagatcttgtgtaccaaggccgagaattccagactggtctcgcaaattgacaacaccaaactgactgcagatgacttgagagccaagtaagcccacccaacaccgtcatcaatgacagagctcaccctgagtctgaccgagatgccctcaacaaaattgtccccatgtctactaaccctcttgccccagatgatgttggcacaagcccagaaaagactttcaaattcaatgaatgattaagattaataactgctcacatgtatacagtacctatagtttctaacttgtgaacccatttgattacctacacaatagttcagtaaaatagataggactaatatattgttactctctttaaggtgagaaatctgtggcttagtgaggctaagttactcacccaaaggtaagcataactagcacaagtcaaaaccgaaacttggacacatgttttctgagccctaatccagtgctttcttcacttacattgcattgccactaggggcagaggaaggacaataaattcccatatctcaaagaacagcaatgtagatccccctagcaaactaatttgggaataataattaagttatgatctatatcaaatggtttcacctccaaagagaataaaacttctaatagaaatacactaagtgaggtgcccagagcaaaatgcagatgagagttctgcttggcttggtttgcatcatctcctttcagatgtctctcttttcccatctggtttttaaagatacgaagctgaggtgtctctacgccagctggtagagtcagatgccaatggcctcaagcagatcctgaatgtgctgaccctgggcaaggccgacctagaggcacaagtccagtctctgaaagaggagctcctttgcctcaagaacaaccacaaagaggtgagacaaagaccaatagagtaatcacaagctaagtccctaaaagtagcatcagttcctttgagttgcacctgacaaagggtgtgcccgcttgtattagttcgttctcacactgctataaagaaataactgagagtaggtaatttataaaggacagaagtgtaactgagtcacagttccacatggctggggaggcctcaggaaacttacaatcatggcttaaggggaagcaggcacatctcacttggcagcaggagacagagagagaccaaagggggaagagccctttataaaactatcagatcttgtgagaactcactcactatcctaagaacagcatgggggacaccacccccatgatccaatctcctcccactaggtccctcccttgacacatgggaattatgggaattacaattcgagatgagatttgggtggggacacagagccaaaccactgctacgtactactctggtttagccctgaaaatacctactgctactagcactggttcaaggtagtatttcaaatccactggctccaacacaatatctggagccataaggggaagaaaggcctccaacatcccctccagcttttctacaagaaggaacccaatttttctgtccttacagtcttcccatgtttgtaggcatccctatacaggcttctgccacctcccattggtacaagtcaatattggtgcaagtcaatattggcacaatcccgtatttgcaccatagagactataatctctcatgatcaattccacctttatcctgtttcacccattatccagccctggaaatgatctaaattttttggaactctggtcttgctactcatttttttttaattttgcacacatttaaacacacagtcctacctgaaagagtcttaaatcattttatagcatctcaataacacctgtaaatcatgtattcctttgttgtgggctatattttagacacaattaagctaaatcgtagcagttagagtgaaacaagaacacaaaggggttatctgttcaccaagtgacttcacagtctttttctttccttaggaaatcaattctttacagtgtcagcttggggagagacttgacattgaagtgactgctgccccttctgctgacctaaaccaggttctacaagaaatgagatgtcaatatgagcccatcatggagacaaaccgcaaagatgtggaacagtggttcaacacgcaggtgggggatatagaaaagtcaaaaacaataagctgatgctgcatttctagggccctttaatcaaagtcatgttttcctcccataatattctcagtctctggctgtgtgtttcagatagaggagctgaatcaacaagtggtgaccagctctcaacagcagcaatgctgccaaaaggagatcatagaactgagacgcagtgtgaacactctggaggttgaactgcaggcccagcatcgaatggtactgagcaagctgaccaagcctagctcagcaaagatggaaacagtcccttacacctgtgtgctgcagtatttcccaaactgtgtctttcagaacaatagttcctcatttgttaaagcgtctatggctgaaaaagagctttgtggccaaataagtctacgaaacgctgcactaaaccaaggttaaacagggtgccttcctgtgagccattaataagctaatatacaccatgaatctccaggaagggggtatatggtattcagcattccaaaacttatttgactgtggatccccccactttttttagaacatctcatggtattaatgattcatgaagtacactttgggaaacactgggagagcattttattatatgcaaagcatttttacaagctatcacatgagatttataaagcaatcctaagagggggggtggcataattattaacgaatgttacagatgaggctccaagagctaaagtgattttcccaagcaaatccaaggtaagtttcagcccacctattttatagagacactgagatcctgagacattaagaaactcatccaaagtcacaaaagaaataagagtctgagccagagtttagattccaaagccagtatcattctgtctcatgataatgcctctctgaagtagagaattgcttacatgctctgatgtgaaggcttttgggaagaccttgccccacactggttttgtcaccagctagtcatgtgaccttggacaacatattgaaccacttgaacctcagttttctcatctataaaaattgggataatcatgcaaataataggctattaaaacctaaaatcccatcattatccatagacttacagaatgatagagcaggaatgaaatttactcatcagtttcaactttcatattttacatataaaggaattgatctggtggataaattgtatatggtaaaacattgcttccttccttttttaagacacgaacactcactgaatgaagtgccatggtaatgcttttttttttttttctttttgagatggagtctcactctgtcgcccagactggacagcagtggcacgatctcgggtcactgcaacctccacctcccgggttcaagcaattctctgccttagcctcccaagtagctgggattacaggtgcccaccagaacacccagctaattttttgtatttttagtagagacggggtttcaccatcttggccaggctggtcttgaactcctgaccttgtgatccacccacctgggcctcccaaagtgctgggattataggcgtgagccactgcgcccagccagtaatgcatttttaatgcctgggtgtgcattaagttattattttttctctcctaagtaggaaagtgtggtgcgagactattggttggtcaagaaagagaaagtgaaacaaatacttacagagaagcaaaaagagaaagagagaaagagggaagagataaaggaaagcagattttagcatagttgatcatttgggttttggatttatttgattaggaaacaataaataaagtgcttggagatctatcagtagtgtcacaaagaaaccattttttttaaatgatacaggtcacaggtgacctgggcttaaaggagtcattataaatcctactatccttctccatggtagagagattcccaagagtgcatcctaacggagacagaggctcgctacacggccttgctgacccagatccagagtctgattgataacctggaagctcagctggcagagatccggtgtgccctggaaagacagaaccaagaatacgagatcctgctggacgtcaagtcccggctggaatgtgagattaccacataccgcagccttctggagagctcggatggcaagtatgtaaaataacagcaacttctatgacaaaaaagtgtaaatgaacgcagatatatgtactgccactggcaacaggggtcaagtgctttgtttgaccttcttgccagtgatggggagcttggacagaggcatccacacaccctctcaagctgtgccatgaggaagacttgcaattgtaaccttatccaaatttgaggcattggctgacctgagctgttctgaagagcccatgggccaggttaatttcttataggttgcttaccttcttagagttttaaaaattactagagaaaaaattatttccccatagatgaatattcctggtgaccattacagatgtttccccactgagatgaacgtctgattttcatgagcttgtacaaaacaacccaggctcctttggaggaacattctgctcaggctgaaacccctaaccctatctagccactagtccttgaggccaacagaagcatgtacacatgtatgttttagcatcttttttaaaaaataaaagttataatttttgtaagcaataagaagctaaccaacccataagtaaacatatatggaggatgagttctttgaagcaactcagtccaaactaaaaccccagagacttagttacaattgcaaaggagacctacttcccgaaaataatcagtgaactcttcacagcattcttttaattggcatgaccacattatgtgagcacaatggtcatcaatgctgtcacctttaggagctgtgatcatataccaaaatacctcgaatcatcaaagaaagattatgtttataaaaagagtgtttactatgaactgctttttacttcagttctctaaaaactatgcatagacagccagaaggcactttgaagcttcctgatgacacagtgaggactctttcatagctggggttcaggccaccactattagtatgactaactcctcaatgagaaaaatatctggttaatttccattcctcggataataatgccctcaacttgttccttatcactgttgatcctgtgggtttagtttccattatatccattctgcagatgaaaaactaaaggttgagtgcgttaaatgacttagctgaggtcaccagctggtaaaggacagagctggtctctgcctcagtcttttgactgctagtgcagtattctttccacaatgtgatggtattgactaatggaaacttacataatcgaatacttctaaacctaggatgctgatttccaatggatttaatctgattctttttcttccagtaactacagtacaaaataaatgaataagcatttagaagtatgtacttgtcttgagcaacacgtgttaaaaaaattagccacaatcatttttctccatgaccatcatcgccttccctcaatcacagctaaaattgtgttttttttccttaggcgtccctgttacccacgtgccaccaaatgtgagccttccccttggacatcttgtaagtccggagccatagaaagcacggccccagcttgcacatcctcatccccctgcagcttaaaggagcactgcagtgcctgcggacccctgtcccggatactggttaaaatttgcaccatcaccaaggagattaaggatgggaaggtcatttcttcttacgagcatgtgcagccttgtttcatcatcagacctgccaaagtctaacatcccaaggtgatgaaaatgacccacatttatgaaacagaggccaatacatgctcctgccagagaggtttaagaaaactccccagtcccttaaggtacttagtttcttactactacagcgggtccccattgctaggtagaatatcttttattctgctccttccctaactcaccactgctaacatgataataaattacatttctctggaaggatgttttgcatttatctgagggatgggaactgatttgtaagcacccaggaagatggcctacattgcttgactacccaggtgattgatgggcaggtctctctcttgtttactcaggccttgtttaccgacattcctccttagagccagtcagacaagtttagggttgtttttggccaccggcacctgaaggtgaaaagctacaaccttcccttctaaatgtctttggatacagaaagaaacatatatgggaacagtataaataggggaaaagatctttaatatttaattcacttgtgtagatagtcacgagtatggatcctattaaactctgctgtcttaattatgatttatctatactaacatactttacctttccaaagatatttttttaaatgtccatggtctccaaaactttgtgacctattaggctctccaaatattttatttgagaatcagataagttgtggggagtgaatctagaacactttgaagaaatagcatgggtcttttcattaaacatttgctatttctctttctattctttagggaatgggagtttgttctgattgtttgacaaggaacatttagctggaattctcaagaaataacccttcttcccctccctgtgaagagtgacaaagaaaaacatagcttagattcctgcttcaatctatccatcagagtaaatggacataatatccacacattttgcagaaaagcaatagtgaataattgctgcttgtaagtgcaaggcagtcccaatgtgagaaggcatcatttatataccagccatcatcacagcttcttacaggatagtctcagaatatgtaagtcattcctgacaataatcattggacattgccagaggttttaagaaataattcaaaatcaaacacagatgggtagtcaaaaggcctgaagtcctacacctgcatttcccagctgtgaccttggggaaaacatttagacttcatcaaatttaatttctgtgtttgttaaatgaggatcatgcctacttcacagggttgttgtgatgatcaaatgaaattgtttatgtgacactgctttgaatgctgaaaagcaccacccaatgtaatttttatgtaagttttgcttttagctacagccctagacctatttttgtaattatctcattttaaaattctttcttcatgaatttagttatccagtcatgattttggagttttaatagtgtttaacttttaggagaaaaaaaaacatgatttcctgtgatcaggcccacaattctactcaataaagcatttttcagttcttagggtatgtatcgcatatcaatgagtcaataatgcctgatgcccacatcaaagacacatgcattgtgtaacttacagcttgatgatttacttcctccagacaagtagcaacttacactaggcaagtggaatgcagaactcccagaatgacctcttttaaatcaataatttctctctcatctgagtgggcagagtacctccggtcagtagttaactgcgtactatctcaggctgcaggatgaaaatgtggaaagagcatggaactgggattcagaaaccttgggacggagtctcaatccagcctgggcatgtatgacctcgagtaaataggatataacaatataagccctgcctaccacacggctgcaaggataaaatggaataataatggtgaaagggtctcataaactgtaaggtgctttgcagaagggcattcctattccctatatttaaacctagacacatgtcgtttccatcaataccttcttcctttctttctggttcagtgctgggcccaggtggaccttgatatatatcatccacactaaaatctgctccgagctacaaaattagggttgaggaatctcactggactcaagctaagattgaactgatgcagcagtgccattttcagtttatcctagaagtaggatgccttcctcctatggagagcaaaatatcccccatgccattcatggttttaaaaaatatatgattataagctgcacagtaaagaggggagttagccactcgaaggcttgcagttttgtttttttttttaagtgtcttcttcgtataagagaatgtaaaaccatttgctggttgtatgcatgtggtcaaaacttttaaaggcaataaggagactggatttttactaggaggctaaataagtatcctacacagccacaggaggaaatttaaggttttatgacagttcagcataagtcagcagctagagcagaaaaggggctcgtggggagggaaagtgtaattttagcacagttcgaaagacaaccatgaatcaggaaacacagcatggtgtccagagcctgaggtcaaatcctatatctctgcttctcactctgagggtccataattatatttcttaaaaagggagatattttagatatattttttctagatttttttcctttcttcttgttgactccacttcatgtcatagctagtttaaactcttccaaacacagaggtaagtaaccacgcttccccctttctccttgcctctcaccccttaactgtcccccatcacctgcccccatcacacagcccacaccctttgcatccttacttcccagagccaattccagcaattgctgatcagaagagactacccagaaacttttcctccagagttcagttagtggtaaccccttacctgacgtcccgccaaaacttctccagtgtgacccagaagccacctgcaattgcattaataggggagtctgtatcattcagattcctgggccttaccccagacctcctgtatctgcatctccagctgtgggacctgggaatccaaattttaacaaaagtctcagctgaagtgtgtgcactgaattaaaagccactgctttatcactgatgggggcttttggcttaaagatctgaatgacttgatgacttatttgaggcttttagatttgggcatagcttgatagacaaccacacatgcagattcccccctccttcgtgtctattcgcctgtttataaaatggagttaatcaataatgaccaataatttaataaatatcatcaactcatttaatcctcacaaccccatcatgaagtagatattattaatagccccatttcacagatgaggaaactgctgggcagaaaatttaactgactcatccatgccgcacaataatgggattgaattatcagtacttttatttccttagaaaggtcaaatagcacctgatacaagaacagaaataatctgtagtagcaacagcttgcttttcaactcttcaaagcacccttctccagctcatcacagcttccagtgagaatcatccaaggagtctttatccctcatccagaaatgcagagaatatgtggatttttgaatgcggaaggtattggatggcagctaatagcatttttaatgtgagagatggagaatctggggcacagaaagaacagtaactggtccatggtacgtgggtcgaaaagaggaccagtgctctttcttctgctcctcactctccttgttccccgtcttctgctcctcactctcctcgttcccaggcacatctgtagtgaacaggtgtggactgaggcctaatgtgaagaacactggaccccaagacagtgacctcaggctctaactctcagaagtaccatttggcttctctgtgcttagactctgggcagtcaccatggactcttcaaagcttacgtccttagtttctcttacaagctctgacattacttatcatgtctagctttctacctctgtaaataagaactgacaccaaaaaaagtcttccaaccccccccaccccactttgccagtgtcttttaaaggcaattggatggtatcagtgagatcttcatgtctttagaagataatgactctatgttgttattaattcccataatttccatttttcaaacaatgaagaaaagtatcttactctagacagaaacggatcccttacctgagtaagtttatcctatttctgtccattttgatttaaaattaaagtttttataatgaaaacacattttaaaagcaaacatccactttaaatgagagaaggggggaaacattaaaattcaagagaaaaggaaagtgtccccaaagagaagagaataggtcattattaggttaggaagaatttctaggctgaggcaatcagcatccgtgacacagacttgggttagtctcagggcaagcaaaccttgaatacattgtttcaacactgtgatcaaatgtcttttataggaaatgaatcctctgggtattgggctggctagaaatatctgatcagtgtgttcatgaatgattcacaagtttcatgggaacaacccacgcacccagttcaaatgggaacaaccctgtttggcaacattgaaaggtttgctgtaattatcctttcaggttaaacatcatatttggagagctttcctaggtgatgcttttgagccacaggctaccacttacatgcacatgggaaaaaatgtatatcaatgtttctaaacatcttaagaaggcatcacaatagcaaaatttctgaatatgttttcttgatcctctctctctctctctctctctctctctttctctctctcaccccccccccctctttctctctctctggaacaacccaatagtcaaggcggacatactagtcgtacctggagaaaacatctcagacagtaagatctcttacttttttcaggaggagagcaagtttgggactcctttctctttttccttctccaaaaacaaacaaacaaaaaaaacagaaacaaaaaagaatcaaaaaggcctttctgctaatccagaagcaaaaatttccgatattacagctcgttatggagggccactgggcacgctagtgctcaagagtttcctggaaagggttgtatccacccatttggtatctgtggcccttaaagaaactgcctaactctactgacccagaagacctagagagagaccatgctttgggctgaacatctctaaacatgggtagctggtcataaagaactacccatcaactgtatgtaagagtaaaaaggtcttctctctgcacttctgtggaggataaatgtctgtcagctcattttccattgaccggaaaaaaataactgtgttctcttccttcactgccactttctaagaaacacccccttccccactcccagcatagactctggttgcagggagaagtctcacagtggaaggtaaataaaattactacccatgtaagaggactctgttaagttcagtggggaaaggagactaggatgaaatctcagaacaagcacccttttaaaggtattagaaaaacctagaaaagaactttggccacctttgtttaaaaagcagaatcatgtactgattaataacacatacttgaatctagaccagctgggtctctgattcccagccctgccacataccatgagatcttgggcaagttacttaatctctctatttcctcatctttaaaatggggctattaatagcatctacttcatagggctgagatgacatcattaattaatgcatgcaaagctcctagagcatgcctggcacccagtaaccttgttagtaggattgcattatactgcttcgtgaagcttacttcagttggcaaaacaatcacatgagagctaatgaattatttcacttgagccaaatgacaatggcatagtcatgcaaagccattctgataactaatgaaagtgctatattaaggatagaacctttctttttaaaagaaagctgagtcacacctgacccaaagtaaaaaccacataaaggtccaactcttctgttttccagaatgttagggagctcagttgtaaaggacctctccatcatgtatcaaccttcacaatctttgcggccagtaggaagaagatagccctggaggagaagggagaacagtttgaagtcatccctgtaacaggatcacttttgtggacaactgaaatgacagggcaattcagagaggactgatggcccttctcctagtacaatatctgttacccttgtctcttgtggccctgatgtttcctggagtcaggttatggtgtcaatggagaaaacagctggaaggcttctccaccgccaacacataataaaagtaatcacagatgcacagaagccacagtgtctcctagggccaaaaagtagaaagagtaatgcttctttcattcaattaaaaactgattaaatattatgcctctagacattgtgctacatgctttacatgaattatctcactcaattctcacaatggccctaccatactatggttattaccacattactaacaagtgaactaaggcttacagaagttaagtaatttgctcagtgtcacagctagtaaatgttaaagtcaaaatctgaacaaactcaaatcctctattccaaatgcccaatcaattaaataattactcaagtttgaaaatgtcatacatgtagcctaatgaaagctataaagaattaaagaaataatgcttgtcttggaggtctaaagaaggtgagccatatccctggtggttcaagtggttaagaaaatattttaaaaagagaaagtgagccctaaaaacacaacacaacagtgtccagcccaatccaggaaggggcaacactgaactcatgaacaccatctaagcacgtgtggacttgaggcagtttttcaacctcattcctcaagaccccatatccctcttctagttccatttttgacaaaagccttcatattacaatttggtttctctaattcttaggtacaacaaagaaggtgcattgatttgcagttgggaactctgtggttgcaaaatggatcatctttcaatgttaaattaataagtttgcattctgtctctttcatctggcacttaaaagtcaggttactctgagtcagctcctgagaatccctttggttctggtgcactaataacccaccagcctaagaacagacatagaccactgtgacttcacaagaaagtatcaccttgtgaagttctgctttggagaccagatgacctaactcaacagcatcttcatctcttctcattctaaccacaacaattaggctgttggatttgtgtgaagtttattgctagaagattggcacagtatagccctgctctactagatataaagccaagaggtcttgaatggagaagcattgggaaagtgtaggtctcatttctaactagttcatattcatggcgagcataggctcaaaacaatgaatgccggatattcatgtttccaacaatttgtggcttcatcagcaattgtgggctgccaaagctgcaggggacttcctggttttgacccatcccaagagtaacaggacacaaggctgataggatgaaatatccaaagtccacccccaggattccattttttttctttttttttttttgagacagagttttgctcgtgttgcccaggctggagtgcaatggcacgatctcggctcaccgcaacctccacctcctgggttcaagtgattctcctgccttggcctcccaagtagctaggattacaggcatgcgccaccatgcccagacaattgtggtttttttttttttttttagtagagacagagtttctccacgttggtcaggctggtctcgaactcctgacctcagatgatccacctgccttggcctcccaaagtgctgggattacaggtgtgagcaaccacacccactgcccccccccacccccacagggtcccttttaagaaaggctacaaattataattagagggatggtaatcagaaatgaaatcaaacgtgttgggttcagaaaaaaacagaagatgctatattagtgtattcaggagaggcactgggagaaatagacaaaataagaaagagaaaggagcaaaatggatatgtttttgtggctgcagagtaagaagaaccaagaggtcatttggagctcacttacatggaacagaatgtacagtgggactaagattgcagggaccgtgtccagcgtcccagttacagcaccgtctctttgtagtaatgacacaaagactatgtagtaaataataattaaggatgaaagacgagctgtggacaaagggtgagatcaggagggaaataggctttggttgtaaataaaagacacatattcacatttgccctaatgatggttcccacgtgccgtggatcttcaggaacagccttccttttatgtaattttatgcttctccgtaaaaattatttgtaaaatgtttaattaaatgtgatttaaattctataattttctgaggtatatcatatatattaatttgaaaatttaaaaatccacctataatttgcctttttagggtttatgaaatatagtaactataaccatctttgctgttacgctaataattaaagatctagactaagtatgtgtatggaaaatatgttttataaatcacatggaaaacacattctattcaccttgatttaatctttgtaggagattggtcagagtggtgggagaaactatagggaaaggatgcaaaccttctgaaagttcagaaggctctgcatagcttcaggggagaataagctgaaggcagctgttctctgatcctgaggcagagggcaaggagtaggtacaaggaggtgtaggggaatttatcgtaaacaggcttgtttacttaggttgtccagaaaccgacctttgataatctgtgcacatgactgctccctgaaaaggggaacaataatgttaattacccgcagattgtgtttgctccaggctttcggcattatgtctgtactgaataaaagcaagcagcttcagctgttcgcagctgctctcttctttggccctaagtgccggcagacccctagctgctcttacactgcacgcctgtgttgtcagtactcccttcatccgacgctcggccagggtctgcaggacagacctggcaaatcttcagcaaaaatccatcaccagagttcctactggatgtttcccccacaaacacacagacactacgatgttctactgccactgtaacaaagtgacatgcatttcatggctcaaaataacacaaaacacgaatgtactatcttactgttctctatttcagaaatctgacttgggactcagtgtactaaaatcaaagtgttggaggtcctgggggggatttgttttattgccaaacttttccagctttcagaggctgctcacattcctgggcttgtccaccatttccatcttcaccatcagccatctcgtcacccttaactctgccttcatcacatctccttcgccaacactgactgaatcttctacttccctcttccacctttttttttttttttttgagacggagtcttgctctgtcacccaggctggagtgcagtgacgcgatcttggctcactgcaacctccacctcccaggttcaagccattctcctgcctcagcctccggagtagctgggattacaggtgtgcaggcatgcaggcatgcaggcatgtgccaccatgcccagctaatttttgtggggttttttgtttgtttgtttgttcgttcgtttagtagagacagggtttcaccatgttggtcaggctggtctcgaacccttgacctcgtgatccacccacctcggcctcctaaagtgctgagattacaagcgtgagccaccgtgcccagcccctcttccacttttaaagacattatgattatcttgggcccacctgaataattcaggatactctccctattttaaggccagctgattagcaaccttaattctacttgtgactttaattacctttttgccaagtaacatcagctattcacaggctctgggtattaggacctgggcatccttcggggaccattattcttcctcccacaccaaaggaaacagagagagggaggggaaaagagacagcccatgtattatctctctaaaaccccaaaaccaaaactggagtaagcaataaagtcacgagtgtttaaattcacgaaccaatcaagcttcccggttgtacttcaaccctcagggaacattctgacataaggagagcatatgtttaaggctatatcttaactaatagtttgaagatgtaaacatactccataaccttgtggggtcatctctttagagcaacaataataacaattaacatttactgagtgcttccaatgtgccaaagtgttaagtgttctctatgtgcatttgctatacaactacccattttgcagatgaagaaagtgaggcacgagaggttcacagccagtcacacagatagttagtgccacagccaggattcacacccaggaccatgggactccaaatcctgcacttttaaccgtcatgaaaaactgcctcttcctcctttttttttttaaccaatatacactttgcaataatttattccctaattgacagagctagaaggaaaagaccagagtgggacctaaccaaaggcatttggaaatggcttttacctgtatttggaaactcaagccttcctagggaagaactatgagttcactgctccactctaccttaaaccccagttattataa

SEQ ID NO: 738 - DNA, 556542 bp, Homo sapiens
  misc_feature (67209)..(117208): n is a, c, g, or t
  misc_feature (303287)..(353286): n is a, c, g, or t
  misc_feature (384032)..(384131): n is a, c, g, or t
  misc_feature (385386)..(385485): n is a, c, g, or t
  misc_feature (386711)..(386810): n is a, c, g, or t
  misc_feature (388031)..(388130): n is a, c, g, or t
  misc_feature (390233)..(390332): n is a, c, g, or t
  misc_feature (393807)..(393906): n is a, c, g, or t
  misc_feature (394951)..(395050): n is a, c, g, or t
  misc_feature (396411)..(396510): n is a, c, g, or t
  misc_feature (398185)..(398284): n is a, c, g, or t
  misc_feature (402632)..(402731): n is a, c, g, or t
  misc_feature (406059)..(406158): n is a, c, g, or t
  misc_feature (410834)..(410933): n is a, c, g, or t
  misc_feature (420139)..(420238): n is a, c, g, or t
  misc_feature (420272)..(420272): n is a, c, g, or t
  misc_feature (424012)..(424111): n is a, c, g, or t
  misc_feature (449946)..(450045): n is a, c, g, or t
  misc_feature (457675)..(507781): n is a, c, g, or t
  misc_feature (507847)..(507847): n is a, c, g, or t
  misc_feature (507899)..(507899): n is a, c, g, or t
  misc_feature (507901)..(507908): n is a, c, g, or t
  misc_feature (507910)..(507918): n is a, c, g, or t
  misc_feature (507923)..(507930): n is a, c, g, or t
  misc_feature (507932)..(507941): n is a, c, g, or t
  misc_feature (507944)..(507944): n is a, c, g, or t
  misc_feature (507946)..(507953): n is a, c, g, or t
  misc_feature (507955)..(507955): n is a, c, g, or t
  misc_feature (507957)..(507958): n is a, c, g, or t
  misc_feature (507960)..(507974): n is a, c, g, or t
  misc_feature (507976)..(507977): n is a, c, g, or t
  misc_feature (507980)..(507984): n is a, c, g, or t
  misc_feature (507986)..(507989): n is a, c, g, or t
  misc_feature (508429)..(508429): n is a, c, g, or t
  misc_feature (508431)..(508431): n is a, c, g, or t
  misc_feature (508433)..(508433): n is a, c, g, or t
  misc_feature (508437)..(508437): n is a, c, g, or t
  misc_feature (508977)..(508977): n is a, c, g, or t
  misc_feature (508979)..(508980): n is a, c, g, or t
  misc_feature (508985)..(508985): n is a, c, g, or t
  misc_feature (508987)..(508988): n is a, c, g, or t
  misc_feature (508990)..(508990): n is a, c, g, or t
  misc_feature (509568)..(509568): n is a, c, g, or t
  misc_feature (509573)..(509573): n is a, c, g, or t
  misc_feature (509878)..(509878): n is a, c, g, or t
  misc_feature (509880)..(509883): n is a, c, g, or t
  misc_feature (509885)..(509885): n is a, c, g, or t
  misc_feature (509887)..(509887): n is a, c, g, or t
  misc_feature (509889)..(509889): n is a, c, g, or t
  misc_feature (509945)..(509945): n is a, c, g, or t
  misc_feature (509947)..(509947): n is a, c, g, or t
  misc_feature (509949)..(509949): n is a, c, g, or t
  misc_feature (510141)..(510141): n is a, c, g, or t
  misc_feature (510366)..(510366): n is a, c, g, or t
  misc_feature (510525)..(510526): n is a, c, g, or t
  misc_feature (510528)..(510529): n is a, c, g, or t
  misc_feature (510533)..(510535): n is a, c, g, or t
  misc_feature (510537)..(510540): n is a, c, g, or t
  misc_feature (511453)..(511453): n is a, c, g, or t
  misc_feature (511455)..(511455): n is a, c, g, or t
  misc_feature (511458)..(511458): n is a, c, g, or t
  misc_feature (511461)..(511461): n is a, c, g, or t
  misc_feature (511463)..(511463): n is a, c, g, or t
  misc_feature (511465)..(511465): n is a, c, g, or t
  misc_feature (512790)..(512791): n is a, c, g, or t
  misc_feature (512793)..(512794): n is a, c, g, or t
  misc_feature (512808)..(512808): n is a, c, g, or t
  misc_feature (512820)..(512820): n is a, c, g, or t
  misc_feature (513590)..(513590): n is a, c, g, or t
  misc_feature (513866)..(513867): n is a, c, g, or t
  misc_feature (513869)..(513869): n is a, c, g, or t
  misc_feature (514179)..(514179): n is a, c, g, or t
  misc_feature (514181)..(514181): n is a, c, g, or t
  misc_feature (514188)..(514188): n is a, c, g, or t
  misc_feature (514239)..(514241): n is a, c, g, or t
  misc_feature (514423)..(514423): n is a, c, g, or t
  misc_feature (514439)..(514439): n is a, c, g, or t
  misc_feature (514452)..(514452): n is a, c, g, or t
  misc_feature (514456)..(514456): n is a, c, g, or t
  misc_feature (514466)..(514466): n is a, c, g, or t
  misc_feature (514479)..(514479): n is a, c, g, or t
  misc_feature (514493)..(514493): n is a, c, g, or t
  misc_feature (514497)..(514497): n is a, c, g, or t
  misc_feature (514504)..(514504): n is a, c, g, or t
  misc_feature (514506)..(514506): n is a, c, g, or t
  misc_feature (514519)..(514520): n is a, c, g, or t
  misc_feature (514526)..(514526): n is a, c, g, or t
  misc_feature (514531)..(514531): n is a, c, g, or t
  misc_feature (514540)..(514639): n is a, c, g, or t
  misc_feature (514644)..(514645): n is a, c, g, or t
  misc_feature (514647)..(514647): n is a, c, g, or t
  misc_feature (514649)..(514649): n is a, c, g, or t
  misc_feature (514651)..(514659): n is a, c, g, or t
  misc_feature (514662)..(514663): n is a, c, g, or t
  misc_feature (514665)..(514670): n is a, c, g, or t
  misc_feature (514672)..(514672): n is a, c, g, or t
  misc_feature (514674)..(514674): n is a, c, g, or t
  misc_feature (514678)..(514683): n is a, c, g, or t
  misc_feature (514685)..(514685): n is a, c, g, or t
  misc_feature (514687)..(514689): n is a, c, g, or t
  misc_feature (514691)..(514696): n is a, c, g, or t
  misc_feature (514698)..(514703): n is a, c, g, or t
  misc_feature (514705)..(514705): n is a, c, g, or t
  misc_feature (514707)..(514707): n is a, c, g, or t
  misc_feature (514709)..(514716): n is a, c, g, or t
  misc_feature (514718)..(514719): n is a, c, g, or t
  misc_feature (514721)..(514726): n is a, c, g, or t
  misc_feature (514728)..(514729): n is a, c, g, or t
  misc_feature (514731)..(514731): n is a, c, g, or t
  misc_feature (514733)..(514734): n is a, c, g, or t
  misc_feature (514737)..(514740): n is a, c, g, or t
  misc_feature (514742)..(514744): n is a, c, g, or t
  misc_feature (514748)..(514751): n is a, c, g, or t
  misc_feature (514754)..(514761): n is a, c, g, or t
  misc_feature (514764)..(514765): n is a, c, g, or t
  misc_feature (514769)..(514776): n is a, c, g, or t
  misc_feature (514778)..(514779): n is a, c, g, or t
  misc_feature (514784)..(514787): n is a, c, g, or t
  misc_feature (514789)..(514793): n is a, c, g, or t
  misc_feature (514795)..(514795): n is a, c, g, or t
  misc_feature (514797)..(514797): n is a, c, g, or t
  misc_feature (514799)..(514799): n is a, c, g, or t
  misc_feature (514801)..(514810): n is a, c, g, or t
  misc_feature (514815)..(514817): n is a, c, g, or t
  misc_feature (514820)..(514825): n is a, c, g, or t
  misc_feature (514827)..(514827): n is a, c, g, or t
  misc_feature (514829)..(514829): n is a, c, g, or t
  misc_feature (514831)..(514833): n is a, c, g, or t
  misc_feature (514836)..(514842): n is a, c, g, or t
  misc_feature (514845)..(514847): n is a, c, g, or t
  misc_feature (514849)..(514849): n is a, c, g, or t
  misc_feature (514851)..(514851): n is a, c, g, or t
  misc_feature (514853)..(514854): n is a, c, g, or t
  misc_feature (514856)..(514856): n is a, c, g, or t
  misc_feature (514858)..(514858): n is a, c, g, or t
  misc_feature (514860)..(514869): n is a, c, g, or t
  misc_feature (514871)..(514871): n is a, c, g, or t
  misc_feature (514874)..(514875): n is a, c, g, or t
  misc_feature (514879)..(514880): n is a, c, g, or t
  misc_feature (514883)..(514886): n is a, c, g, or t
  misc_feature (514888)..(514890): n is a, c, g, or t
  misc_feature (514892)..(514895): n is a, c, g, or t
  misc_feature (514898)..(514898): n is a, c, g, or t
  misc_feature (514900)..(514901): n is a, c, g, or t
  misc_feature (514903)..(514903): n is a, c, g, or t
  misc_feature (514906)..(514906): n is a, c, g, or t
  misc_feature (514908)..(514909): n is a, c, g, or t
  misc_feature (514911)..(514912): n is a, c, g, or t
  misc_feature (514914)..(514917): n is a, c, g, or t
  misc_feature (514919)..(514919): n is a, c, g, or t
  misc_feature (514922)..(514924): n is a, c, g, or t
  misc_feature (514927)..(514928): n is a, c, g, or t
  misc_feature (514930)..(514932): n is a, c, g, or t
  misc_feature (514934)..(514936): n is a, c, g, or t
  misc_feature (514938)..(514939): n is a, c, g, or t
  misc_feature (514941)..(514943): n is a, c, g, or t
  misc_feature (514945)..(514947): n is a, c, g, or t
  misc_feature (514949)..(514950): n is a, c, g, or t
  misc_feature (514952)..(514954): n is a, c, g, or t
  misc_feature (514957)..(514972): n is a, c, g, or t
  misc_feature (514975)..(514976): n is a, c, g, or t
  misc_feature (514979)..(514980): n is a, c, g, or t
  misc_feature (514982)..(514985): n is a, c, g, or t
  misc_feature (514988)..(514990): n is a, c, g, or t
  misc_feature (514993)..(514994): n is a, c, g, or t
  misc_feature (514996)..(515006): n is a, c, g, or t
  misc_feature (515008)..(515009): n is a, c, g, or t
  misc_feature (515011)..(515016): n is a, c, g, or t
  misc_feature (515018)..(515018): n is a, c, g, or t
  misc_feature (515020)..(515020): n is a, c, g, or t
  misc_feature (515022)..(515026): n is a, c, g, or t
  misc_feature (515028)..(515028): n is a, c, g, or t
  misc_feature (515031)..(515032): n is a, c, g, or t
  misc_feature (515034)..(515039): n is a, c, g, or t
  misc_feature (515043)..(515043): n is a, c, g, or t
  misc_feature (515045)..(515048): n is a, c, g, or t
  misc_feature (515053)..(515055): n is a, c, g, or t
  misc_feature (515059)..(515062): n is a, c, g, or t
  misc_feature (515064)..(515066): n is a, c, g, or t
  misc_feature (515068)..(515075): n is a, c, g, or t
  misc_feature (515080)..(515081): n is a, c, g, or t
  misc_feature (515086)..(515086): n is a, c, g, or t
  misc_feature (515088)..(515089): n is a, c, g, or t
  misc_feature (515092)..(515103): n is a, c, g, or t
  misc_feature (515108)..(515109): n is a, c, g, or t
  misc_feature (515114)..(515114): n is a, c, g, or t
  misc_feature (515116)..(515117): n is a, c, g, or t
  misc_feature (515120)..(515130): n is a, c, g, or t
  misc_feature (515135)..(515136): n is a, c, g, or t
  misc_feature (515141)..(515141): n is a, c, g, or t
  misc_feature (515143)..(515144): n is a, c, g, or t
  misc_feature (515147)..(515158): n is a, c, g, or t
  misc_feature (515162)..(515163): n is a, c, g, or t
  misc_feature (515168)..(515168): n is a, c, g, or t
  misc_feature (515170)..(515171): n is a, c, g, or t
  misc_feature (515174)..(515187): n is a, c, g, or t
  misc_feature (515195)..(515195): n is a, c, g, or t
  misc_feature (515197)..(515198): n is a, c, g, or t
  misc_feature (515201)..(515213): n is a, c, g, or t
  misc_feature (515216)..(515217): n is a, c, g, or t
  misc_feature (515222)..(515222): n is a, c, g, or t
  misc_feature (515224)..(515225): n is a, c, g, or t
  misc_feature (515228)..(515238): n is a, c, g, or t
  misc_feature (515244)..(515244): n is a, c, g, or t
  misc_feature (515273)..(515273): n is a, c, g, or t
  misc_feature (515659)..(515659): n is a, c, g, or t
  misc_feature (515664)..(515664): n is a, c, g, or t
  misc_feature (515667)..(515667): n is a, c, g, or t
  misc_feature (515671)..(515671): n is a, c, g, or t
  misc_feature (515673)..(515673): n is a, c, g, or t
  misc_feature (515675)..(515675): n is a, c, g, or t
  misc_feature (515955)..(515955): n is a, c, g, or t
  misc_feature (516014)..(516014): n is a, c, g, or t
  misc_feature (517231)..(517231): n is a, c, g, or t
  misc_feature (517235)..(517235): n is a, c, g, or t
  misc_feature (518575)..(518575): n is a, c, g, or t
  misc_feature (519478)..(519478): n is a, c, g, or t
  misc_feature (520134)..(520134): n is a, c, g, or t
  misc_feature (520393)..(520393): n is a, c, g, or t
  misc_feature (521171)..(521171): n is a, c, g, or t
  misc_feature (522525)..(522525): n is a, c, g, or t
  misc_feature (522789)..(522789): n is a, c, g, or t
  misc_feature (522913)..(522913): n is a, c, g, or t
  misc_feature (523079)..(523079): n is a, c, g, or t
  misc_feature (523534)..(523535): n is a, c, g, or t
  misc_feature (523539)..(523539): n is a, c, g, or t
  misc_feature (523541)..(523541): n is a, c, g, or t
  misc_feature (524048)..(524048): n is a, c, g, or t
  misc_feature (524051)..(524051): n is a, c, g, or t
  misc_feature (524587)..(524587): n is a, c, g, or t
  misc_feature (524591)..(524591): n is a, c, g, or t
  misc_feature (524594)..(524594): n is a, c, g, or t
  misc_feature (524607)..(524607): n is a, c, g, or t
  misc_feature (525489)..(525489): n is a, c, g, or t
  misc_feature (525667)..(525667): n is a, c, g, or t
  misc_feature (525824)..(525825): n is a, c, g, or t
  misc_feature (525834)..(525834): n is a, c, g, or t
  misc_feature (526913)..(526913): n is a, c, g, or t
  misc_feature (526924)..(526924): n is a, c, g, or t
  misc_feature (526927)..(526927): n is a, c, g, or t
  misc_feature (528150)..(528150): n is a, c, g, or t
  misc_feature (528296)..(528296): n is a, c, g, or t
  misc_feature (530204)..(530204): n is a, c, g, or t
  misc_feature (530219)..(530219): n is a, c, g, or t
  misc_feature (530243)..(530243): n is a, c, g, or t
  misc_feature (530816)..(530816): n is a, c, g, or t
  misc_feature (532274)..(532275): n is a, c, g, or t
  misc_feature (532278)..(532278): n is a, c, g, or t
  misc_feature (532280)..(532280): n is a, c, g, or t
  misc_feature (532282)..(532282): n is a, c, g, or t
  misc_feature (532284)..(532285): n is a, c, g, or t
  misc_feature (533493)..(533493): n is a, c, g, or t
  misc_feature (533495)..(533495): n is a, c, g, or t
  misc_feature (533603)..(533603): n is a, c, g, or t
  misc_feature (534042)..(534042): n is a, c, g, or t
  misc_feature (534045)..(534045): n is a, c, g, or t
  misc_feature (534536)..(534536): n is a, c, g, or t
  misc_feature (534539)..(534539): n is a, c, g, or t
  misc_feature (534720)..(534720): n is a, c, g, or t
  misc_feature (535355)..(535355): n is a, c, g, or t
  misc_feature (536866)..(536866): n is a, c, g, or t
  misc_feature (537206)..(537206): n is a, c, g, or t
  misc_feature (537568)..(537568): n is a, c, g, or t
  misc_feature (537570)..(537570): n is a, c, g, or t
  misc_feature (537572)..(537572): n is a, c, g, or t
  misc_feature (537577)..(537577): n is a, c, g, or t
  misc_feature (538711)..(538711): n is a, c, g, or t
  misc_feature (538726)..(538726): n is a, c, g, or t
  misc_feature (538736)..(538737): n is a, c, g, or t
  misc_feature (540253)..(540253): n is a, c, g, or t
  misc_feature (540446)..(540446): n is a, c, g, or t
  misc_feature (540451)..(540451): n is a, c, g, or t
  misc_feature (541000)..(541000): n is a, c, g, or t
  misc_feature (541115)..(541115): n is a, c, g, or t
  misc_feature (541117)..(541118): n is a, c, g, or t
  misc_feature (541663)..(541663): n is a, c, g, or t
  misc_feature (541665)..(541665): n is a, c, g, or t
  misc_feature (541667)..(541667): n is a, c, g, or t
  misc_feature (541672)..(541672): n is a, c, g, or t
  misc_feature (541676)..(541676): n is a, c, g, or t
  misc_feature (541680)..(541680): n is a, c, g, or t
  misc_feature (542254)..(542254): n is a, c, g, or t
  misc_feature (542257)..(542258): n is a, c, g, or t
  misc_feature (542344)..(542344): n is a, c, g, or t
  misc_feature (543279)..(543279): n is a, c, g, or t
  misc_feature (543947)..(543948): n is a, c, g, or t
  misc_feature (543951)..(543951): n is a, c, g, or t
  misc_feature (543953)..(543953): n is a, c, g, or t
  misc_feature (543955)..(543955): n is a, c, g, or t
  misc_feature (543958)..(543959): n is a, c, g, or t
  misc_feature (543985)..(543985): n is a, c, g, or t
  misc_feature (543989)..(543989): n is a, c, g, or t
  misc_feature (543994)..(543994): n is a, c, g, or t
  misc_feature (543996)..(543996): n is a, c, g, or t
  misc_feature (543999)..(543999): n is a, c, g, or t
  misc_feature (544001)..(544001): n is a, c, g, or t
  misc_feature (544776)..(544776): n is a, c, g, or t
  misc_feature (544780)..(544780): n is a, c, g, or t
  misc_feature (544782)..(544782): n is a, c, g, or t
  misc_feature (544785)..(544785): n is a, c, g, or t
  misc_feature (544935)..(544935): n is a, c, g, or t
  misc_feature (545798)..(545798): n is a, c, g, or t
  misc_feature (545803)..(545803): n is a, c, g, or t
  misc_feature (545818)..(545818): n is a, c, g, or t
  misc_feature (545823)..(545823): n is a, c, g, or t
  misc_feature (546663)..(546663): n is a, c, g, or t
  misc_feature (546793)..(546793): n is a, c, g, or t
  misc_feature (546808)..(546808): n is a, c, g, or t
  misc_feature (546811)..(546811): n is a, c, g, or t
  misc_feature (546813)..(546813): n is a, c, g, or t
  misc_feature (546841)..(546841): n is a, c, g, or t
  misc_feature (546845)..(546846): n is a, c, g, or t
  misc_feature (546857)..(546857): n is a, c, g, or t
  misc_feature (546862)..(546862): n is a, c, g, or t
  misc_feature (546867)..(546867): n is a, c, g, or t
  misc_feature (547023)..(547024): n is a, c, g, or t
  misc_feature (547027)..(547027): n is a, c, g, or t
  misc_feature (547039)..(547039): n is a, c, g, or t
  misc_feature (547041)..(547043): n is a, c, g, or t
  misc_feature (547045)..(547045): n is a, c, g, or t
  misc_feature (547047)..(547047): n is a, c, g, or t
  misc_feature (547054)..(547054): n is a, c, g, or t
  misc_feature (547059)..(547059): n is a, c, g, or t
  misc_feature (547270)..(547270): n is a, c, g, or t
  misc_feature (547273)..(547273): n is a, c, g, or t
  misc_feature (548552)..(548552): n is a, c, g, or t
  misc_feature (548555)..(548558): n is a, c, g, or t
  misc_feature (548561)..(548561): n is a, c, g, or t
  misc_feature (548564)..(548564): n is a, c, g, or t
  misc_feature (548566)..(548566): n is a, c, g, or t
  misc_feature (548568)..(548568): n is a, c, g, or t
  misc_feature (548570)..(548570): n is a, c, g, or t
  misc_feature (548572)..(548572): n is a, c, g, or t
  misc_feature (548575)..(548575): n is a, c, g, or t
  misc_feature (548577)..(548579): n is a, c, g, or t
  misc_feature (548583)..(548584): n is a, c, g, or t
  misc_feature (548586)..(548594): n is a, c, g, or t
  misc_feature (548597)..(548597): n is a, c, g, or t
  misc_feature (548599)..(548599): n is a, c, g, or t
  misc_feature (550831)..(550832): n is a, c, g, or t
  misc_feature (550834)..(550834): n is a, c, g, or t
  misc_feature (550836)..(550836): n is a, c, g, or t
  misc_feature (551179)..(551179): n is a, c, g, or t
  misc_feature (551182)..(551182): n is a, c, g, or t
  misc_feature (551186)..(551186): n is a, c, g, or t
  misc_feature (552155)..(552155): n is a, c, g, or t
  misc_feature (552158)..(552162): n is a, c, g, or t
  misc_feature (553082)..(553082): n is a, c, g, or t
  misc_feature (553442)..(553443): n is a, c, g, or t
  misc_feature (553585)..(553585): n is a, c, g, or t
  misc_feature (553591)..(553591): n is a, c, g, or t
  misc_feature (556046)..(556046): n is a, c, g, or t
  misc_feature (556128)..(556128): n is a, c, g, or t
  misc_feature (556130)..(556130): n is a, c, g, or t
  misc_feature (556136)..(556136): n is a, c, g, or t
  misc_feature (556481)..(556482): n is a, c, g, or t
  misc_feature (556485)..(556485): n is a, c, g, or t
ccaaatgaggacagactatgtcacaattatagtatgcaaaatgctttttaaataactgtcttagtttataaaatatattatgaaatcaaattgtcagaaaaacaaaggacaaaataataaaagggtttattcactggaaacctatgacaattatacacatttacataattgtgtgtatatatctaattatgtattcacaccaatatgtatgcaccttacatgagtatttttaaatatctcaataatatcttgacagaacataagcaaaaacggcaatatattaaaagtataatattttaatacaccagttctgtaattaataaaaaagccagatagaatattaaaaagtaaacagacgacatgaaaatactgtaaagcaattagatataacagatgcatacagaacactctacacaaaaacaaaactcacaatcttctcaaaagctcatgaaacattctcctaaaaataactatgaagccaaaaaacaattctgaacagaatttttgaaaaattgaatgttacaaaaaattcaaaaaatcaatgaatataggagttatttttttgaaaagatcaacaaaatagactgctagcaagactaataaagaaaagagagaagaatcaaagagaagcaataaaaaatgataaaggggctatcacccctgatcccatagaaatacaaactaccatcagagaatgttataaacacctctacgcaaataaactagaaaatctaggagaaatgggtaaattcctggacatatacatcccccacaagactaaacaaggaagaagttgaatctctgaatagaccaataacaggttctgaaattgaggcaataattaatagcctaccaaccaaaacaagtcgaggaccagacggattcacagctacattctaccagaggtacaaaggggagctggtaccaacccttctgaaactattccaatcaatggaaaaagagggaatcctctctaactcattttatgagaccagcatcatcctgataccaaagtctggcaaagacacaacaaaaagagaaaattttaagccaatattcctcatgaacatcgatgcaaacattctcaataaaatactggcaaaccgaatcaggcagcacttcaaaaagcttaaccaccaagatcaagtgtgcttaatccctgggatgcaggttcaacatatgcatatcagtaaacataatccatcacataaacagaacaaatgacgaaaaccacatgattatctcaatagatgcagaaaaggccttcgaaaaaattcaacagcctttcatgctaaaaaatgctcaataaactagatattgacagaatgtacctcaaaataataggaactatttatgacaaactcacaaccaatatcatgcagaatgggcaaaaactggaagcactccctttgaaaaccggcacaagacaagaatgtcctctctcatcactcctattccacatagtgttggaagttatggccagggcaatcaggcaagagaaagaaataaagcatattcaactaggaaaagaggaagtcaaattgtccctgtttgcagatgacatgattgtatatttagaaaactccgtcgtctcagccaaaaatctcctaagctgataagcaacttcagcaaagtctcaggatacaaaatcaatgtgcaaaaatcacaaacattcctacaataccatacagagagtcaaatcctgagtgaactcccattcacaattgcttcaaagagaataaaatacctaggaatccaacttacaagggatgtgaaggacctctttaaggagaactacaaaccactgctcaacgaaataaaagaggacacaaacaaatggaagaacattccgtgctcatggaaaggaagaatcaatattgtgaaaatggccatgctgcccaaggtaatttatggattcaatgtcatccccaccaagctaccattgactttcttcacagaattggaaaaaactaccttgaagttcatatggaaccaaaaaagagcccgcatagtcaagacaatcctaagcaaaaagaacaaagttggaggaatcgcgctacctgacttcaatctataatacaaggctacagcaaggaaagcagcatggtactggtaccaaaacagatacatagaccaatggaacagaacagaggcctcagaaataacaccaaacatctacaaccatccgatctttgaaaaaaactgacaaaaacaagcaatggggaaaggattccttatttaataaatggtgctgggaaaactggctggccatatgcagaaaactgaaactggatcccttccttacactgtatacaaaaattaagtgaaaatggattaaagacttaaatgtaagacctaaaaccataaaaacttacaagaaaacctaggcaataccataggcatggacaaagacttcatgactaaaacaccaaaagcaatggcaacaaagccaaaattgacaaacgggacctacttaaactaaagagcttcttgtaaagggcccgctaggcatacccaaagcgggcagaaggctcctcaggggaaggtaaggtttgagggagtgcaggtgaggcacctgtggcagaaaaaaaaaaacgcaaaacaaaaaaaaaaaattcgccgccaagaagcgttcctggttcccccacggacgaaagtgccttcccatcagtccctgcactgggccttggatactctggcgtccctggttcgaacccagggagcgactcaggcccgctaggggtaccccaaagcgggcagaaggcccctgaggggaaggttaggtttgaggaaagggaggtgaggcacctgtggatgaaaaaaaaaaaaagaaaaaaactcagcgtcgagacgcattcctgggtcccccacggaagaaagtgccttcccatcagtccctgcgctgggccccggtgaccctggcgtccccggttcgaaccaagggtgcgtctcgggcccgctaggggtaccccaaagcgggaagaaggtccttgaggggaagttaaggtttgagggaggggagatgaggcacctgtggcaggaaaaaaaaaaaccgcgccgccaagaagcggagactgggtcccccaaggacgaaagtgccttcccatcagcccccgcgcatggccccgtgaacctggcgtccctggttcgaacccagggtgcgtctcgggcccgctaggggtactccaaagctagcagaaggcccttgaggggaaggttaggtttgagggaggggaggcacctgtggcaggaaaaaaaaaacaaaccgagccgtcgagaagccgagactgggtcccccagggacgaatgtgccttcccatcagcctctgctctgggcctggggaccctggcgtcactggttgaacacaaggagcgtctcgggcccactagggatacctcaaagtgggcagaaagcccctgcggggaaggtaaggtgtgagggagaggaggtgagtcacctgtggcacaaaaaaaaaaaaaaaaacgcgccaccgagaagcgttcctgggtcccccacggacgaaagttccttcccatcagcccctgtgctggaccgcggggaccctggcgtccctgcttagaacccacgcagcgtctcgggccggctaggggtacaccaaagcggacaaaagccactgaggggaaggtaagctttgagggaagggaggtgaggcacccgtggcaggaaataaaaaaaaaaagcgccccggagaaccggggcctgggtcccccacggacaaaagtgccttcccatcagtccctgggttgggctccggttaccatggatcgccggttccaactcagggccctctcgggcccgctaggggtaccacaaagcgggcagaaggcccctgaggggaagttaaggtgtgagggaggggtggtgaggcagctgtagcagaaaaaaaaaggaaaaaacagcgcgcctccgagtagcgttcctgggtccttctcggaagaaagtgccttcccatcagcccctgcgcatggccccgggaccctggtgtcccttcgaacccagggagaatctcggcccgctagggtttccccagtgcgggcagaaggcccctgaggggaaggtggggtttgagggagggaaagtgcagcacctgtggcaggaaaaaaaacaaaacagaactcgccaccaggaagcgttcctgggtcctgcacgcacgaaagttccttcccttcaatccctgcgctgggacccggggaccctggcgttcctgattccaacccagggagggcctcgggccagctaggggtatcgcaaagtgggcagaaggcccctgaggggaaggttaggtttgagggaggggatgtgaggcacctgtggcaggaaaaaaaaaaatcgcgccgccgagaagcggggcctgggtcccccatgcacgaaactgccttcccttcaacccctgctctgggtcccagggaacctggcgcccctgattcgaacccatggagcttctcgggcccgctaggggtaccccaaagcgggcagaaggcccctgaggtgaaggtaagatttgagggaggggaggtgaagcacctgtgtcaggaaaaaaaaaaaaaaaaatcaaccgcgctgccgagaagcgttcctaggtcttccacggacgaaagtgccttcccatcagcccctgcacatggccccggaccctggttcgaacccagggagcgtctcggtcccgctatgtgtaccccaaagcgggcagaaggcccctgaggggaaggttaggtttgagggaggggaggtgagtcacatgtggcagggaaaaaaaagaaaaaaaaagaaaaaaaaacctcacagccgagaagcggggcctgtgtcccccatgcacgaaagtgccttcccatcagccctcgctcacagccccgggaccgtagcgtacctggttcgaaaccagggtgcaaacaaaactattatcagattgaacaggcaacctacagaatgggagagaatttttgcaatctacccatctgacaaagggctaatatcaggaatctacaaatagctaaaacaaatttacaagaaaaaaaaacaaccctatcaaaaagtggggaaaggatataacagacacttttcaaaggaagacatttatgcagccaacagacatatgaaaaattgctcatcattggtcatcagagaaatgcgaatcaaatccacaatgagatatcatctcacgccagttagaatggcgatctttaaaatttcaggaaacaacagatgctggagaggatgtggaaaaatagaaacacttttacactgtgggtaggagtgtaaattagttcaaccattgtggaagacagtgtggtgattcctcagggatctagaaccagaaataccttttgactcatcaatcccattactgggtatatacccaaagagttataaatcatgctactataaagacacacacacacatatgtttattgcggcattattcacaataacaaagtcttggaaccaacgcaaatgtccatcaatgatagattggattaagaaattgtggagcatatacagcatggaatactatgcagccataaaaaggatgggttcatgtcctttacagggacatggatgaagatggaaaccatcattctcagcaaactatcacaaggacttcaaaccaaacaccgcatgttctcacttataggttggagttgaacaatgagaacacatggacacagggcggggaacatctcacattggggcctgtttgggggtgacggactatgaaaggaatagcgttaggagaaatacctaatgtaaatgatgagttgatgggagcagcaaaccaacatggcacatgtatacctgtgtaacaaacctgcacgttctgcacatgtaccctagaacttaaagtataataaaaaaattgaatgttacatactataatttctgaccaaaaaggattaaaactagcaatcgataacagaagaaaattcatacaattcacaaatatgtaaaaattaagcaatttactcttgaacatgcttttgttcaagagttagaaaacttactattttgaacatgtctataatgccaaaagtgacctacagatttaatacaatccctataaaattcttaattttatttttgacagatacagaaaatgtgactcccaaaagtatatggaatttcaggagaccacaaagaactctacagttttcaaaaagagaaaaattttggaaacattacagttcctgttttcaaaacctgttacaaatctacagtaatctaagtagtttgttactggcataaagacagacaaatagactaataaaaccgagtgcaaaaaagatgtaaacgctcacgtatttattgtagctttacttacaaaaatcaataggttaaagcaatccatacttccctcaacaaacaaatgaatgggtacaatttggaatataaaaacaatagaatattacccagcttttgaaaagcagaaaaccttttatctataataaaaataaaatcttgatgacattatgctaaataaaataagccagctacaagacagatactgagtgtatccacatgtataaaatatctaaagtagtaacatccttagaaacagagaataagatagcatttgtaaagggctgaacaaaggagaagacaggcagttgtttcaggtgtattgagttttagttttgtaagataaaaatgttctagagatacgtcgaataatgtcaatgtgctgaaaagtctaaactatataattattgtcattgtaaattattgtaaaattgtaaataattgtcaattttatatgtttcttataacaatgtaaacaataataatatctaagtgagataccgttttaatgcatttcaataattatcttcaggacctcggcaaaacctgagtcctgtcctctcgctttcctccccgtacacagcgagcttcaccacttgctccgcaccttctccatcaactactacctgtccctgggatctgtccagtcgcccagctaaagtgctcagcaggtcagcagcgcggcgagcttctatgaggcgtggggtctggggctcctggatctctgtgtcccatttcacagagattgccacctactgccgcctgctagaagatggggaggacttcaatcttggtggtattctggacagcagcaaatacctgtaaagcatccaaaagaccaacacccacaggatagtggacggcaaagtggtgtttgagaccaacatcacagacgtcttgaggtgctaaaccagcagaagcaaggtccctttgcggagcaggagggcaataaaaacttctgtggtcaaaaaaaaaaaaaaaaaaaaaattacccccgcatcacagaggtgttttcctcacgcaaacgtaatatagattcattaatacatagatgtggaaattagggcaatttccacaactactcacccagagaggattaaaaaaataattgaccaccaactaattaaataaatacagaagtcataaataaagcatgagtaatgtttatacagtcaaacgaacagagaattatgtttgcaatacacatatggttgattcatatttgactttttttctacactcttttaaagtgtacacagttaaatatagtcataaaaaattataacatataagcagaaactaaaaacacaattaaatgatgtaagacagcctatcctaacaggaaaatacaggaatataaaatattacaaaacaaaattggataaacattaacctgtgaaatactgaataaacaaatcatgcaactgaagaagactctttctagataactgaaatattcaaccataactggacacccataaagaacagattttgaattattagcatatggttagagtaacaaaatttcacaacaaatgcattataatcttctataaagaacatttagaagaaaattttaatgaagatttcaatgatattagagaacagagtctcgctctgttacccaggctggagtgtagtggcgagacctcggctcactgcatcctccacctaccaggctgaagcaattctctgccccagcctcccgagtagctgggattataggcacccgcccccatgccctgctcattctttctgtggtttttgtggagacggggtttcaccatgttggccaggctggtcttgaacccctgacattgtgatccacccacctcagcctcttaaagtactgggattacaagcgtgagccaccgcactggcctataatttgtttttttttttaagtaaagaaaagctttacatttttaaatatgggaacaacatgaatactgaaaaatatgcaatgaaacactactacataataagcaatgagaaataaattatactatcattcagataatgttgaggaaagttaatagaaacactaatgataagtttttctatgcagtaaacttagacacacaaactgaaattttattaatgtgaggtgcatactaagtaattcactttttatataacacataaattcaagtatgctattctgaaatccctgaagctaaaattataggctaatttgggatacataaaaatcaaaaagtgaaaacgtgcagatcacagtcccactaagctttatataagattaaataataaaataactcaataagaaatcatgtaacaattaagaatttattctattcttggcaggtttctaagtttttctatggcattaaggtctttaaaaattctttgaggtgagtagatacaataaactattccacaggtgaggtgcttggcatagagagttcacgtttttaagttaatttctaccaaggaaaagaaaactttttgacctacattaccagagatgaaaaaaagaataaagtgaaatagaagcttcactatatcatatgtgctgaggtgttttgggctctgataaaagtttttccgatttttttgcaggatcacatttgaaatcataggactgaaaattatgaagcagaaacatttgtccttggtgtttctgaaatatgtgaaccaaaccccaatgcctgcacttttactctcacaaacttctgacatgaggaacagatttttacaaaatagcttaatatagaagtctcgcaaaatgtgcagatttccccagatcccccaaaacaatggaaaagcactcagaccacaaggccttcaagggaataacagaaagaagaggagaacttcggctgtcactgtgaatgccctggaatgttagtggagggacaggaggagccttagaagatttaggagcataataagcatagggtaggaaatgtccatctgtggcagcaaaagaagtaaatctaggatcttccagaaccaatttcattgaagcgaacttcccacatcacatttttaaagtttcctccttggcctttgcacctctcatctttgttatttgttcattattgcctattggggtgatgcctattattttctctctttttacattccaaagatatttcctttactgtagaacaggggcatccaagggagaatctcaccacgaccccaggtctagagcgcccggagtccgccatccctgggaatggaggcggcttcggcctggggtcgtggtgagattcgttggtggctgcgcgattgtggcggagttgcaagcaaacgggtttcatcaccttaaatggttttgaaccaaagaagctgtattcccttaaaaagacggacaacccatcgtgtgaactatagagtttgtgaacaaatttatattgggttcatagtggcgtcatgcacgcagactcctgcgagttcccctaagttcttagaggactgctttgccttttgatctgagagttgcaaatttccctaaagaatggcccttgtggataagcgctaagtcaagagacagtgattggacagaatttgtgaggaattcgcccccagatcatgaaagtcaccctgaaccccgcctcgtggtggctctgctggatggacgggactgcactgtggacatgcccatcctgaaggacctggccacctggccttctgtgaggctcagtccatgcaggagatccacgagaaagttctaaacgaagtcgtgggcgccatgatgtaccacaccttctccctcaccagggaagacctggaaaatttcaaggccctgagagtgatcgtgcaggtgggcagtggctacgacaacgtggccatcaaggctgctggcgagctcgaaattgctgtgtgcagcatcccgtccgcagccgtggaagagacagccgactccaccaccggccacatcctcaatctgtactgggggaacaggtcgctgtaccaggcactgagggaaggcacgcgagttcagagcgtggagcagattggcgaggtggcctcagtaaaggctcgcattcgtggggagatattgggcctcatcggcttcggtcgcacgcagcaggaggttgcagttcgagccaaggcctttgcaggatgggatcgagcggtccctgggtgtgcatagggtctacacccagcaggatttgctgtatcagaacgactgcgtcttcttgcattgcaatctcaacgaacaaaactaccaccttatccatgactttactataaagcagatgaggcagggagcattccttgtgaacgcagcccgtggtggcctggtggacgagaaagcctgagcacacatcctcaaggagggcagaatacgaggggcagccctcgacgtgaatgagtcggagccctttagttttgctcggggtctgttgaaagatgcctggaatctcatctgcactcctctcactgcctgctacagccagcaggtgtcactggagatgagcgaggcagttgccactgagatccgccaagccatcataagtcgcatcccgggaagcttaagaaactgtgtgaacaaggaattctttgtcacatcagcgctttggtccgtaataaaccagcaagaaattcatcctgagctcagtggtgctacctacagatatctgccaggcatggtgggcgtggctccaggaggacttctgcagccagggaagacatcatccctggagacatcccagtgactgacaacctcccaacagtggtacatccttcccaagggccctctcccaacagcccacaaaacacggggacagtcgagagcatcccaacgagcaatagcagagaatgccggaaggtaattattcagatatacttgggaacagtgaaaaatagataatctaagagaaaaagaatctgacggcctttttagctgattccggacatatgcatcattgttgttgcagtgttaaaacaagagctagaaaactgacaatgtcgtctgcttacggaagctctgaaagactagggtgtgatttattaacgcccaacttctattattgtgtgttaagtttttcatctgtgcatcaaatcacaaagaataaatagaacttttccctttatcagtcccttaggcacagcaggtcctgaacaccctgcttatatgttgcatcagcagttcaaatatgaaaataaaaaccatgaagaggaaatccgcatcctgtgactggagtcccttcagtctacagggactggttaccgctttttgctaataggaagattacattactagaaaatgtggagtaaactgtttgcctgtggtaaacacctgcatgcaaaggattgaagacagtaccggctcctgtacagagacgcgtctctcacatctgagctgcatattgagcggcaagttggttgtaagttcagtaaaagccgctgatgatgcaaaaaaaaaaaaaaaagtattaagtttcacaagttgttagtaatcaagtatattttctcagtttcagatcctctgcgattttattgagtggaaagtcttgcgctgaaagggttcaagaaaaataatattgcatttccttatgtcacaggaaacacttttaatggtaacttgtcagactatgaacaaacccactttttaagatattgataaagtcttcttttcttcacgtgatattttatacaagtacacttcagatgtattggatgtggctgattttaacaaatcctattagatttgtatcaattagttacatgttctattcatagtcttttgtgaatcattgcctttttgtttaaaaagatggcctattttgagcctttgtataagtacattcctgtttttgtgacaaaagaaaaactttaaatttgtcccaaagagaaaaataatggctatcagaagtatgctttgttttagtgcgagttaccgttactgtatttgtgtattgtaaaggtggacattctaattacattaaaatgtaattagaaaaaagtgcttaatgaacaaaaacagaacatagacaacaaaagaatattagaagtgatgcatgaagaaaacgagatatcaataaaaagatttttaaaaaccaagaaaaattgtgactctgaagaacacagtaactatattaaaaatttaatcagcagtcacaaaagtggatttaataaagcagaaaaaattagacagttgataacattgcacttataaatactgattcatgaaaacaaattttttaaacagaatagagaaaaaatgaaaattgggacttacttacagcacaccaccaagtggaccactgtatttataaaaggagtcttagaaaaacagtataggagaaaaataataaagaggatatttttaaaaagtagctgagaactccctagatgacaaggtaattaaacaagaagaaatcatgctaaacaaaaaccttcaactggaataatttcacttcagaaaaaaaagttaagcatttccaaaacaaataaaagttgagtgtgttactgaccactggaacactgctaaaggaaatgtaaaagaaagtctatcacgtccaaaaatgacaatatatgctgcacagcgtcataaaagcatatgaaaatagaaagctctctattaaatgtaaatacataaacagctatagaaacctctactgtcataatgatggtgcacaaaactttcacgttattgctatggaatttaaaaaatgaagcagaaagctgcataaatatgggttcatagatactcaataagaaaagataacaagtgatattaataacaaagtgggggtataaagaggtaaagctttgcattccattgaaatatagtcattatatattgtcataactttaagatgttttatgaagtctttatttctcaagatgattacaaaaaaacctgtagatggtatgcagaagcaaatgagaaagaaactgaatcatgtcactacaaaatcaatgaagaaaaataaagcagtaagagaaaaaaatgataaataacacatctacaagaaacacagaagacaattccaaataataatagtaacttcattaactacagtaattacttcaaatacaaaaagttaaataccttaaacaaaatgcagaaaatgatttaatggattaagaacaaagaagatccagcaatgtactctctacaagagtcattttagctctaaggacccaaataagttgaaagtagcagtataaagaaaatatattttatgcaaagagtagctacaattggaggggcatggtcataattatattaaacaaaatatattttaagttaaaaattttaaaaagagacagattgttattaagtaacggtgacatggattaacttgcaagaaatccataacaataatttagaaatcatatatataatttgaaaaatctgcaaaaatataccattgggattttgataaaaattacattaaatttttatattactataaataacactgatatctttcttatttttttttttggagatagagtttctgtctcccaggctggaggacaatggcacgatctcgcgattggctcacttcaacctccacctcccaggttcaactgattctcgtctttcaaatatgtaaaaccaatattgacagaagtcaagcaagaaatatatagcaacacaacaattgcggactccaagactccactttcaataatgactagaatagtcagatgtaatatcagtaagaaagccaaacctgaacattatagacctaacaagcatttacagaactctgcgatcgaaagcagcaaaatatgcaatattctcaatcacacatggcacattctgttaggatacatgtcttattaaatttaagaaaactgaagtcatgcaatgtaaatgaaactagaaatcaaaagcaagaaaatgtttcagatacgtaaataagaggaaattaagcaagatcttacatatagtcttgctcaagtgtcaggtgatttaatattgttaagatgtcagggccggcacgtgactcatgcctgtaatcccaggactttgggaggccaaagtgtgtggatcacttgagatcagaagtttgagactagcctggccaacatggcaaaaccctatctctactaaaaatacaaaagttagctatacatgttggtgcatgactgtaatcccagctactctggtggctgagactggagaattgcttgaacatgggaagcagagcttgcagtgagcacagctcacaccactgcccttcagcctgagtgactcactaaaactccatctccaaaggaaaaaaaaaaagttgtcagtattacccatgatgatataaaaatgtaatgtaattttcatctaaatcccaatggtattttttttgcagaatttttgtgtataattctaaaagttgtttaggaactgtgactaggcaaacaccctttaaaaaggacaaagagttattacattttctgatttaaaatcatgatacaaagctacaaaaataaaaacaatatggtattgccacaaaaacggatacatagatgatgaaacagaatagacatcctggaaataaaccctcgcatacgtgataaaataatcttccatatgctttccatgaccatgcaatagaaaaataagaatctctttaacaaagaattttcaaaattgaatgtttacagagcaaaaataaagttggatgcttcttttgtattatacataaaaagaaaagttgttttataatggatttaatgcttaaacataaaaactaataaaattcttagaagtaaacataggggaaaagtttatgacataagtcttaaaactttgcttaagtatgacatcaaattcataagaaacaaggaaaagaacaaaaaagaaaggaactacattaaccttcaagtattctacacatcaaggaaaaatttagtggcatacaaatgtcacctaataagtgggtgaaacctgggcatgctggctcatgcctataattctagaaatttaggaggccaagtcagaacgatcatttgaggccaaaagtttgagactagccatgaaaatatatcaagaccctgtcttgtatagggtaatatatgtgcatacatacatacatataacaaaaaagtgtaaaaatattttctaatcacatatttcgtaggtgttaatttccaaaagatataaacttctaaaattcaacaacaacaaaatgttaataacttgatttagaatggtaaatgtttgaaatgacctttctccaaagaagacatagaaatgactaggtatttaaaaggatactcgtccgagggcaggactatgggaggctgccctgtacggaaaataagaagaaatggcagtaaagagggcaaccatcattccacccagcccaaaaggaataagagaaaccctatctttcaggattctcaagacacagttttcatggagtgataatgaaaggagcagcagccgccttaatatcccagagagagcaggtggaccagaaagcaacttaaaccagattgttactgaacccaatgcaaactttccccagttcttgcatgaggggtatgtaccatgccaaggtctttactcccatatcaaccagaccttgaaggaggctcacttcaacagcctgcagcagtgagggcaagctccaacatgatgaattaggacttccttattccaacctaaactgtgtttataaaagtaattgcatacaaactaaaaaaaaagtctattggtttttaagtctaaattttaagtaacaagttaatgggcagtagtttaattggggttttacttcactgctatacttttaaaggggctgtgaataaatgtttatgaaattaaaaaaataaaaaataaaaggatactcgacatcactcttctagaaaaatgcaaagcaaagtcacaataatctacggcctcaagccgatatttaaaatagtatgacagctcttcaaaaaatttaaaatgagattattatataatccagcaaacccccttctggctatgtacttaaaatgtacaacgcagatctggaagagatatttgcacaaccaaatttattgcaatattattaacacaagccaaaaggcagaaacaatccagatgtcccttgaccaatgaacagattaataacaagtggcacatacacaaagtcgaatattattcagtctttaaaaagacacattatatgataattctggagaagatcatgttaattgaaataagccaggaacaaagtgacagtctatgattccattcataatcaggtatcttaagtagataaactcataggaaaaaaaagttagaatggtgcttgtcaaggactgaagagatggtaaaatgggcagttgttttattttttatttttttattttttttatttttttaaattatactttaagttttagggtacatgtgcacattgtgcaggttagttacatatgtatacatgtgccatgctggtgtgctgcactcactaactcgtcgtctagcattagttgtatttcccaatgctatccctcccccctccccccaccccacaacagtccccagagtgtgatattccccttcctgtgtccatgggatctcattgttcaattcccacctatgagtgagaatatgcagtgtttggttttttgttcttgcggtagtttactgagaatgatgatttccaatttcatccatgtccctacaaaggacatgaactcatcattttttatggctgcatagtattccatggtgtatatgtgccacgttttcttaatccagtctatcattgttggacatttgggttggttccaagtctttgctattgtgaataatgccacaataaacatacgtgtgcatgtgtctttatagcagcatgatttatagtcctttgggtatatgcccagtaatgggatggctgggtcaaatggtatttctagttctagatccctgaggaatcgccacactgacttccacaatggttgaactagtttacagtcccaccaacagtataaaagtgttcctatttctccacatcctctccagcacctgttgtttcctgactttttaatgattgccattgtaactgatgtgagatggtatctcattgtggttttgatttgcatttctctgatggccagcgatgatgagcattttttcatgtgttttttggctgcataaatgtcttcttttgagaagtgtctgttcatgtcctttgcccactttttgatggggttgtttgttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttgtcttttgttgtcattgcttttggtgttttggacatgaagtccttgcccatgtctatgtcctgaatggtaatgcctaggttttcttctagggtttttatggttttaggtctaatgtctaactctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcggcattatttctgagggctctgttctgttccattgatctatatctctgttttggtaccagtaccatgctgttttggttactgtaaccttgtagtatagtttgaagtcagatagtgtgatgcctccagctttgttcttttggcttaggattgacttggcgatgcaggctcttttttggttccatatgaactttcaagtagttttttccaattctgtgaagaaagtccttggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcttaggtattttattctctttgaagcaattgtgaatgggagttcactcatgatttggctctctgtttgtctgttgttggtgtataagaatgcttgtgatttttgtacattgattttgtatcgtgagactttgctgaagttgcttatcagcttaaggagattttgtgctgagacaatggggttttctagatatacaatcatgtcatctgcaaacagggacaatttgacttcctattttcctaattgaataccctttatttccttctcctgcctaattgccctggccagaatttccaacactgtgttgaataggagtggtgagagaaggcatccctgtcttgtgccagttttcaaagggaatgcttccagtttttgcccattcagtatgatattggctgtgggtttgtcatagatagctcttattattttgaaatacgtcccatcaatacctaatttgttgagagtttttagcatgaagggttgttgaattttgtcaaaggttttttctgcatctattgagataatcatgtggtttttgtctttggctctgtttatatgctggattacatttattgatttgcatatattgaaccagccttgcatgccagggatgaagcccacttgatcatggtggataagctttttgatgtgctgctggattcggtttgccagtattttattgagggtttttgcatcaatgttcatcaaggatattggtctataattctcttttttggttgtgtctctgcccagctttggtatcagaatgatgctggcctcacaaaatgagttagggaggattccctctttttctattgtttggaatagtttcagaaggaatggtactagtccctccttgtacctctggtagaattcagctgtgaatccatctggttctggactctttttggttggtaaactattgattattgccacaatttcagatcctgttattggtctattcagagattcaacttcttcctggtttagtcttaggagagtgtatgtgtcgaggaatttatccatttcttctagattttctagtttatttgcgtagaggtgtttgtagtattctctgatggtagtttgtatttctgtgggatcggtggtgatatcgcctttatcattttttattgcgtctatttgattcttccctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttcaaagaacatctttatttctgccttcatttcgttatgtacccagtagtcattcaggagcaggttgttcagtttccatgtagttgagcggttttgagtgagattcttaatcctgagttctagttgaattgcactgtggtctgagagatagtttgttacaatttctgttattttacatttgctgaggagagctttacttccaactatgtggtcaattttggaataggtgtggtgtggtgctgaaaaaaatgtatattctgttgatttggggtggagagttctgtagatgtctattaggtccacttggtgcagagctgagttcaattcctgggtatctttgttgactttctgtctcgttgatctgtctaatgttgacagtggggtgttaaagtctcccattattaatgtgtgggagtctaagtctctttgtaggtcactcaggacttgctttatgaatcttggtgctcctgtattgggtgcatatatatttaggatagttagctcttcttgttgcattgatccctttaccattatgtagtggccttctttgtctcttttgatctttgttggtttaaagtttgttttatcagagacgaggattgcaacccctgcctttttttgttttccatttgcttcgtagatcttcctccatccctttattttgagcctatgtgggtctctgcacgtgagatgggtttcctgaatacagcacactgatgggtcttgactctttatccaatttgccagtctgtgtcttttaattggagaatttggtccatttacatttaaagttaatactgttatgtgtgaatttgatcctgtcattatgatgttagctggttattttgctcgttagttgatgcagtttcttcctattctcgatggtctttacattttggcatgattttgcagcggctggtactggttgttcctttccatgtttagtgcttccttcaggagctcttttagggtaggcctggtggtgacaaaatctctcagcatttgcttgtctgtgaagtattttatttctccacttatgaagcttagtttggctggatatgaaattctgggttgaaaattcttttctttaagaatgttgaatattggcccccactctcttctggcttgtagggtttctgccgagagatccgctattagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccctgctagattgtggaagttctcctgaataatatcctgcagagtgttttccaacttggttccattctccccatcactttcaggtacaccaatcagacgtagatttggccttttcacatagtcccatatttcttggaggctttgttcatttctttttattcttttttctctaaacttcccttctcgcttcatttcattcatttcatcttccattgctgataccctttcttccatttgattgcatcggctcctgagtcttctgcattcttcacgtagttctcgagccttagttttcagctccatcagctcctttaagcacttctctgtattggttattctagttatacattcttctaaatttttttcaaagttttcaacttctttgcctttggtttgaatgtcctcccatagctcagaggaatttgatcgtgtgaagccttctctcagctcgtcaaagtcattctccatccagctttgttccgttgctggtgaggaactgcgttcctttggaggaggagaggcgctctgcgttgtagagtttccagtttttctgttctgttttttccccatctttgtggttttatctacttttggtctttgatgatggtgatgtacagatgggttttcggtgttgatgtcctttctctttgttagttttccttctaacagacaggaccctcagctgcaggtctgttggaataccctgctgtgtgaggtgtcagtgtgcccctgctggggggtgcctcccagttaggctgctcgggggtcaggggtcagggacccacttgaggaggcagtctgctggttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctctcccagcctcgctgccgccttgcagtttgatctcagactgctgtgctagcaatcagtgagattccgtgggcgtaggaccctccgagccaggtgcgggatataatctcgtggtgcaccgttttttaagccggtgtgaaaagcgcaatattcgggtgggagtgacccgattttccaggtgcgtccgtcacccctttctttgacttggaaagggaactccctgactccttgcacttcccaagtgaggcaatgcctcgccctgcttcggctcgcgcacggtgcgcgcacccactggcctgggcccactgtctggcactccctagtgagatgaaccgggtacctcagatggaaatgcagaaatcacccatcttctgcttccctcaggctgggagctgtagaccggagctgttcctattcggccatcttggctcctctctcttgcttcactgttaaaggggtaatgttctatctaaaacttggagtcagctgatataaaagttttaactcttaagtggagatagggatgctatgtagcaagattgctgacctgcatgcatggcttaacacttgccttgcactgccttaaattgtgacaataatttggtattatattgccacagagtcagttttgtcagtcttatgatctctattttaacattagtgctgatgatttgttgtacctaaagagcaaacagaggtacaacagcaaacaggtgtgtaacaaggcctgtctgtctcctcctgttctgtgtgggagatgctgatgggagaagaaaagacacacacacaatacctttaagggtaaacaacttttttatcccatgtaaatggtattgcagatatctatatctatatctatatttttatctatctatatatatgtatgtatgtatctatctatctatatctatatctatgtatatgtactcaccagactatacagcattcatggccagatggggaagcaacagcctaggctccagagttggctactacacccaccagactatggaggattcacttttcagcttcaagatcaccgctggaagctcagggacttcccatattccaggatagaaactcctccagttctccctcttggcaattgaatggtcggggggaactgaccttagtgaaaattgggtatctaaattagtggaatttgaacctttgactgtgcatgaagtgctgcaggggatttcagtcagcaaaggagatgccagggggatctcttagcatagatggtgcttgcttactgcttataagttaatgtgttgagatagaaatcaattgctacaagataaatgtaagctggaaaaagaaaacactactctgacttccagactggccctggctcaatttcaggcctatgtcttgactgatcaggctcaaagctaacagattattgatgagaaaaacagctgtgcaagtggtgtggtcagggtaaaactgaagaacgagtcagctggggcttggtgtgggtaaaaacccagttcctatctgaagaatgggaaattagcctttacaaatttcaagaacctgcacaaactataaaattgctttgcatcccatggaacgcaaggaaaaagtccattttaccaaaggctatggttaaaatactagaatttgcaacccctaccactaaaaaggaggcccagaaatgtattggcttgtttgaattctggagacatcttcccggtttgggtaacatctcacaacctctgtatgcagtcactagaaaatataatgactttcactggaggtagaaagagaacacagcctttgagcaagctaagcaagcagtgcatctggccctggatggcccatatgggatgggacagtagaattgcaaataactgtcctggattaacatgctaattggagcctttggcagaaacaagatgggaagaggggactcttggggtttcaaacctggaagctgccagaggctggcgaagcttataatccttttgagaagcgactgttagcttgctatcgggctttgctggaaatggagactctctgcttcaaccatgatgtcttcataaggcctgaaattcctattatgacttgggtcatgaggtccaccaaaacccatcgaatagggcatgctgaagaaagtagcatcacataatggaatggtatatacaagatagggcaaagccaggaccaaagggggtatcatttttaaaaaatttgccaactcagaaagccaccgaacaagtcctgcaggcagggaaagagacctgcctcatccaaagcatcagaaacatgcttggtttactgatggatctgccaaatacattggtgggacccgatgcggggaggccgtggcttataatcctgttaaaaacataagtatttctgatgaaggaagggatgggagcagccagctggctgagctagtagccatcttcccagctattcagaagaaggccagagggatttgacacttgtataccaactcttggtcagtagcaaatggtcttactatctagatgcctcaatggcaatgaggcaaatggttaattgggaataaaaaggtttggggaaagaatacagggaagatatctgaatccctgtgcaccctaccattaacactgttatgttgatgctcatgcatctctgctttctcttggcagactaattaatcagcaggcaggtcaacaggccaaaatttccaccataactgcaaactcaaatgtggatgaacggattacaacacgtgcaagcattggaatgagaggcattatagtgtatggtggtgtaattgatagtgattaccggtgagagttaaaaatcttttaacacaataccaccgaaaattcttttgccataaagccgcagatgcagattgctcagctactggtagtaccgtgtcaccaattaacccccgaggaaatttctgccccaataggaacatcatatagaactggaggatatgggtccaccaaagtgggcagcttaaatcctggggccacagtatgggggcagaaaatgaggggagtagtaaaattttaaaaacaatgttatgttcccctctgtttttgttattaaaaggaatagcctatcgaatgatggtcagcacctgcttctttgtgtctgaggccaagaatgcatttagcaactgggtagccaccgctgcaaaagaagtcaactgcagttagagctgccttttagtcgaattgccacaggctgcagggaatgggctcccttaaaaaattgtctctgccaacatttccaagtggttacatcactaccaagggggtcaggagaatagcacctgtaatcccacctggacttcttttaaccaaatcaaagagtctatttttgcccaagtctgacaaaaggagaaatccacttttgcaatgcatcaaaggcctttgtatcctacccaatatacttggaaagacatatacagggaacctaccataccggtagctgaactccatatggcaccgcacccccgctttgtctggaggccttaaatggctcttttaatgttactctggggtttctcccaccagacaattgtcaacacatactccaaatcaacagcattgtccccaatgaaacacaacctctttcctaaatctagatgcttccaaacatcactggttacaaatgcgccagaatccctgatggggtgtaccctataacagtgttctcctctgccactgatacaattctgtttcagcaaaaaatttaaatattaagcttacatgtagaaaaagctcttaatggtagtagcactggacttatgttgttatcagaggaatttgctcagttgtgtactgttgtgttgcaaaatcaaatggcattaggtatgcttaccgcagcccaaagagcgtttcagccttgctgcatactgaattttgtgtgtgtatccctgacagttctcacaatattactctcctcgcccaagacatgcaaggacaagcaaaacaaaatctaactgtcaggaccccatcatgaattggctgtccaactggcattggcgttggccttggtgggtgcggtttttattaactgtgttttaattctcctctgcttaccctgcttctgtaacctctaccaattatgtattcctcgtatatctgtaagcgtattttcttacatttgagtatcaattgggacagaatacgcagaaaaagttaaataatatatttaaactcaattgaacatggacacaaataatggtcaccaagtctcggaataggttttgtgagccccttgaggcattcatccagcactgtttcagagaaatctctatttcaatctattcctatactttagttattgaaaaacaacagacaacggcaaaagcaaattgacctttttgtgttcctttgtgcatggatgagtggctgactctggagcccaggctgttgcttctcggtctggtgatgaatcctccatagtctatcctcatatatatatatacacacacatttttttccttctccccttcccactgcaatttgcttattgtatcaatttgcttattctatcatttgcttattatatctgcattgccatttatgtgggatcgagtttgttgacctttaaaggtattgtgtgtgtgtgttttcttcttccctggagcatctcctgtacataacacctctcttgctgtcatagccagaaattcagtttttaagtttttttctggggtcttcttgctcaagaggaagtatgttcagttgatacggggcttagaattttatttatagcttttattacattctaaaacccccagcagaaacaagtcttaacaaacacagattttaatttctgaacattcttctaataagttttgcacaggtagcggaacaactaaaaaaactgttttttgcattgatggtctacctcattacaatttaacctctaaagggtgttttagtcagctctagagtctgctacggttaaggtgaatttactgcttcttcccataataaagaatggtattttaaaataacataacttctatggcatatatttttaaagcatgaccacaatttgaataattagaacatttaaaaattcgaaatattgttatactgacactgcaccaaaatttatccttccaatgatgacagggaatttttaatagttgttatttttatagtaaaattaaactttaataaaataactgacttacaaacttcagcaagaagacacatattcagccagagatatcagttcccctttagaaaaaaatactcacttctcattaaaatctctctgtatcttactgatttcagatagaatttaaatttcaccttaataacagaaacaaaagaactagttaatctaacaaaaactaataaacgtatgcccaaatttactggcagaatcatgggtacgtcatataatagtaacattctaccagttttaagtaaaataaataaggaaataatcttaacagtgcaacctaccaggaggggcctatccctactcccaggtgagtgggaaccctgcgctctgggggggttgcgcctcagcctctggcacctcttgttggcagcgtcgccgttgcaggcacagggcaggcgttgggggacgtgcagtgggccaggcccaggcacgtcctttgccaggggctgggcaggtgcggagaggggcggagcggtgctgccctggtcgagggagcctccagctctggacagtttgctgcccctgccccagggggggttaaaggagctgagtggggaagcggagggacgaggggattcaggccaggccaggtggccctttagccctgggtgatgcaggaggggctgtggaagaccagagaagacccggagcagaaactgggaactgatatctctggctgaatatttgtcctcttgctgaagtttgaaagtcagttatttcattaaagtttaattttattataaaaatagcaactattaaaaattccctgtagtcactggaatgataatttttggtgccgtttcagcataataatctttggagtttttagatattctaattattcaaattgcggccatgtttcaaaatatatgccatataattttatggcattcgcctctgtgtccctgttggctcaggaaacgtgcttcttcctccttccgcagactcggatcaggccgcccttcctcctggcgtctgaggcgggcatggggacagcctgccagcgaatatcctgacaatgcccggcctgtgccctgtgctcagcgtggggtcctggttggtgcccctcagagcccctcacaaagtagcgcgacaggtgtggaaggacccagcacccggcagcggtgagcagatggatgctccagggatgtggggcagctggcagtcaagaacccactgccaaattcaatggcataacgttgcatatttttcccttatatttttgtgtaggagttttacagctttcagccttacatttgtattttcttaacataggattccagaacaatgctacgagggtctgaatgcctgtcccacacgtaggattccagaacacatcagctgtggtctgaatgattgcccctcacatatgattccagaacagtcctgctgtggtctgaatgattgtgcctcacacagggttctagagcactcctcccctagtctgaatgtttgtccgtcagacaagattccagaacactgctgctgggttctgagtgtttgtccctcacatacaattccagaacactgctaggtgggtctgaatgtttgtacctcacataagattccagaacactgttatgagggtctgaatctttgtccctcacgtaggactccagaacactcctgctgtgttctgaatgtgatttcctaacataggattacagaacaatgctacgagggtctgaatgcttgtcccacaagtaggattccagaacactccagctgtggtctgaatgattgtccctcacataggattccagaacactgctgctgggttctgagtgtttctcccttacataggattccacaacagtgctacgagggtctcaatgtttgtcccgcacataggactccagaacactcctgctgtgttctgaatgtattttcctaacctaggaatccagaacagtgctacgagaatctgaatgcttgtcccacacttaggattccaggagatgccagctgtggtctgaatgatggtccctcatataagattccagaacaatgctgctgggttctgagtgtttgtccctcacataggactgcagaacactgctacgagggtctgaatgattgtacctcacataggattacggaacactcctgctctggtctgaatgtttgtccctcagatgggattccagaacactgagtttgggatctgagtgtttgtccctcacgtatgactccagaacactgcctcatggttgtaaatgtttgtccatcacataggattccagaacactgctatgagggattgaaagtttgtcccgcacataggactccagaacattcctgctctgctctgaatgtttgtccctcagataggattccagaacacagcttctgggttctgagtatttgtccctcacataggattccagaacactgctacgtgggcctaaatgtttgtccctcacataggagtccagaacactgctgctttggtctgaatgtttgtccctcacttaggattccagaacactccttctgtggtctgaaagtttctccctcacaaaggattacagaacactgctcctggtttctgagtgtttgtcttttacataggattccagaacactgctacgagggtctgaatgtttgtccctcatataggattccagaacactactgctgtggtctgaatacttgacccttatataggattccagaacattcctcctgtcatctgggtgtttgtgcctcacaagggtttccagatctatcctgctgtgttctgaatgtttccccctcagataggattccaaaacatttcttctctggtctgagtgtttctccctcaaataggattccaaaacactgctactggagtctgaatgtttgtccctcacataggattccagaacactgctacgagggtctgaattattctccctgacatagcattccagaacactcctgctgtgttccgaatgtttgtctctcactcaggattccagaacactcgtgctgtggtctgaaagtttgtccctcacttaggattccagaacactgctgttggtttctgagtgtttgtacttaacgtaagattccagagcacagctacttgggtctaaatgtttgtccctcagataggattccagaacactgctaagaggttctgaatgtttgtccctcacatagcatttaagaacactgctacgagggtctgaatgttttccctcacataggatcgaagagcactgctgctgggatctgaatgtttttgggcacataggattccagaactctcctgatgtggtctttatgtttgtccctcacatagaattccagaacactgctgctgagttctgcttgtttgtccctcatttaggattcaagaacactcctgctgtgttctgaatgtgtgtctctcacataggattccagaacattgccaggagggtctaaatgtttctctgtcacctaggattatagaacactgctgctgggttctgagtgtttctccctcactttggattccagaacagagcttcgggggtctgaatatcagtccctcacataggactccaaaacactcctgctgtggtcggaaagtttgtccctcacattggattccagaacgctgatgctgtggtctgaatgtttgcccctcatataggattccagaatactcctgatgtaatctgaatgtttgtacctcacataggattcctgaacactcctgctgtggtccgaatgtttgtccctcacatggcattccagagcactgctgctggggtctgaatgtttgtccttgacataggatttcacaacactgctaagtgggtctgaatgtttgtcccttacttaggataccagaaaactcctgctgtactgtgaatgtttattcctcaaatacaattccagaacactgcttctgtagtatgaaaggctgtccctcacagaggattccagagcactggtaggaaattctgaatgtgagtccctaacataggattccagaacactgctgctgggttctgagggtttgtacctgccttaggatttcaggacactgttacgagggtctgattgtttctccctcacataggattccagaacactgctgctgggtctgaatgtttgtccctcacataggattccagaacactgctaagagtgtctcaatgtttgtccctcacataggattccaaaacactgctacgaggttctgaatgtgagtccctcacataagattccagaacactgctgctgtggtctgattgtttgtccctcacataggattccagaacactgccgctgtggtctgaatgtttgtccctcacataggattccagaacactcctgctgtggtctgaatgtttgtccctcacttaggattccagaacagtactgtggggttctgagtgtttgtccctcacgtatgattccagaacactgctacttgggtctaaatatttgtccctcacataggattccagaacactgctgctggggtctgaatgtttgtcccttacataggagtccagaacactcctgttgtagtctgaatgtttgtccctcacataagattccagaacactgctgctggattccgagtgtttgtctctcacataggattccagaacactcctacgggggtctgaatgtttgtccctcacataggattccagaacattgctaagagggtccgcattattgtccctcacataagattccagaacaatgctaacagggtctgaatgtttgtccctcacataagattccagaaccctgctgcagtggtctgaatggctgatcctcacataggattccaaaacactcctgctgtggtctgggtgtttgttcctcaggtgagattccagaacaatcttgctgtggtctgaatgtgtctccctcacataggattccaaaacattcctgctgtgatctgagtgattgttcctcaaataggattccagaacactgctactcgggtctgaaagtttgtccctcacataggattccagaacactgctaccagggtctgaattattctccttcacataggattccagaacactcctgctgtgatctgaaagtgtgtccctcccctaggataccagaacactgctgttgtgttctgagtgtttttccctcatgtaagattccacaacactgctgttgtgttctgagtgtttttccttcatgtaagattccagaacactgctacgtgggtctaaatgattgtgcttcaaatacgattccagaacacttcttctggggtctgaaagtttgtccctcacatcggattccagaacactcctgcagtggtctgaaagtttgtccctcacatagtattccagaacaatgatgctgtgttctgaatgtgtgtccctcacataggattccagaacactccttctgtgatctgaatgtttttccctgacaaaggattccagaacactgctgctgggttctgattgtttgttcttcacttaggattccagaacactgatatgagggtctgatgtttgtccctcatataggattccagaacactgctgctgggttctgactgtttctccttcacataggattccagaacactgccttgacggtctgaatgattatacctcacataggattccagaacactcctgccccggtctgaatgtttgtccctcatatgggattccacaacactgctgctgggttttgagtgtttttccctcacataggattccaggacacttctaagagggtcttaatgtttttccctcacataagattccagaacactgctacgagagtctgaaagtttgtccctcacataggatttctgaacactgctatgaatggtctgaatgtttgtcccacacaaaggagtccagaacactccagcggtgttctgaatgtattttcctcacataggattccagaacaatgctatgagggtttgcatgcttgccccacacgtaggattccagaacatcccagctgtggtctgaatgattgtcctcacataggattccagaacactcctgctgtggtgtgggggtttgcgccacacatggaattccagaacaatcctgctgtggtttgaatgtttttccctcacataggactccagaacactcctgctgtggtctgagttttctccctcaaataggattccagagcactgctaaggcggtctgaatgtttgtccctcacgtaacattccagagcactgctacgaggttctgaatgtttatcccttccataggattccagaaccctactgctgtggtctgagtggttgaccctcacatatgattccagaacactactgctgtggtctgggtgtttgtgcttcgcatgggattccagaacaatcctgctgtggtctgaatgtttctcactcacataggattccaaaacattcctgatgtggtctgagtgtttgtccctcaaataggactccataacactaccattggggtatgaatgtttgttcctcacataggattccagaacactgttacgagggtctgaattattctccctcacatagctttccagaatacgcctgctgtggtctgaatgtttgtccctcaattaggattccagaacactgccgttgggttctgagtgtccgtgcctcacgtatgattccaaaacactgctacgtgggtctaaatgtttgtcccacacataggactctagaacaccgctatgagggtctgaatatttatccctcacataggacttcaaaacactcctgccgtgctctcaatgtattttcctcacataggactccagaacaatgcgacgagggtctggatgcttgtcctacccttaggattccagaacaccccagctgtggtctgcatgtttgtccctcagataggattccagaacactgctgcttgatttgtttgtccctcagagatgattccagaacactgctatgagggtctgaatgtttgttcctcacatgagattcgagaacactcctgctgtggtctgaatgtttgtcccaaacctaagattccagaacactgttgctgggttctgagtgtttgtctctcacataggattccagaacaaatgtacaagggtctgaattattttccctcacataggattccagaacactcctgctcttgtctgaatatttgtccttcacaaaggattccagaacactactgctgtgatctgaatggttgaccctcacacaggattccagaacatttctgctgtggtctgggtgtttgtgcctcacatgggattccagaacaatcctcctgtggtcttaatgtttctacttcacataagattccaaaacatttatgctgtggtctgagtgtttgtccctcaaaaaggattccagaatcctgttaggagggtctgaattattctctctgataggattccagaacacggctacgagagtctgaatgtttgtccctcacaaagtactccagaagactcctgatgtgttctgaatgtattttcctgacataggattccagaacaatgctacgagtttctgaatgcttgtcccacacataggattccagaacacccccgctgtggtctgaatgattgtccctctcataggattccagaacactgctgctgtgttttgagattttctccctcacataggattccaaaagactgctacgaggttctgaattattctccatcacatgggattccagaacacccctgctgtcttctgaatgtttctccctcacatagtgttccataacactactgctgggttctgagagtttttccctcacataggattccagaacactgctacgagggtcagaatgtttgtccaacccatttaattccagaacaatcccgctcttgtctgaatgtttgtccctcacataagattccagaactctgcagctgggttctgattctttgtctctcacgtaggattccagaacacttctacgagggtctgaatgtctgtccctcacataagattccagaacactgctgctgggatatgagtgtttgtccctcacataggattacagaacacggctacgagggtctgtatttttctccttgacataggattccagaacactcctgctgtggtctggatgtttctccctcacttaggattccaatacaatactgctgtggtctgaatggttgtctctcacataggattccagaacaatcatgctgtcatctgagtgtttgtccctcaaataggattccagaacactgctatgaaggtctgtattattctccctcacataggattccaaaacaatgctagaagggcctgaatgtttttcccacacttaggattccggaacaccccagctgtggtctgaatgactgtccctaacataggattcctgaaaactgctgctgggttctgagtgtttttccctcacataggattccaaaacactgctacgagggtctgaatgtttgtcccttacaaaggattccagaacactactgctgtggtctgaatatttgatcctcacataggattccaaaacacagctgctgggttattagtgtttccccctcgcataggattccagaacactgctaagagggtctgaatgtttgtccctcacataagattcctgagcactgctacgagggtctgaatgtttctgcttcacatagcatttccagaacaccaatgctgtggtctgaatggttgaacctcacataggattccagaacactcctgctgtggtatggatgtttgtgtctcacatgggattccagaacagtcatgctgtcatctgagtgtttgtccctcaaataggattccagagccctgctacgacggtctgtattattctccctcacataggattccagaacacggctacgagggtctgaagatttgtcccacacataggactccagaacactcctgctgtgttctgaatgcattttactaacataggattccagaacaatgctacgagggtctgaatgcttgtcccacacgtaggattccggaacaccccagctgtggtctgaatgactgtccctaacataggattcctgaacactgctgctgggttctgagtgtttttccctcacataggattccaaaacactgctacgagggtctgaatgtttgttcctcacaaaggattccagaacactactgctgtggtctatttgaccctcacataggaatccaaaacactgctgctgggttctgagtgtttctccctcgcataggattccagaacactgctacgaaagtctgaatgtttgtccctcacataagattccagaacactactgctgtggtctgaatggttgacccacccaaaggattccagaacactcctgctgtggtctgtgggtttttgcctcacatgggattccagaagaatcctgctgtgatctgagtgtttctccttcaaataggattcctgaacactgctacgagggtctgaattattctccctcacataggattccagaacactcctgttatggtctgaatgtttgtccctcacttaagattccagaacactgatgttgggttctgactgtttgtccctcaagtacgattccagaaccctgctacgtgggtctaaatgtatgtccctcacataggattcctgaagactcctacaagggtctgaatgtttctcccgcacataggactccagaacactgctatgagggtctgaatgcttgtcccacacgtaggattaaagaacaactcagctgtggtctgaatgattgtccctaacatgggattccagaatactactcctgggttctgagtgtttgtccctcacataggattccagaacactgctatgagggtctgaaaattgtccctcacataggattccagaacactgctacgagcatctgatttattgtccctcacataggattccagaacactcctgctgtggtctgaatatttgtccctcacataggattccagaacactgctacgagggtctgtatgtttgtcccgcacgtaggtctccaggacactactgctgtattctgaatgttcttcctcaaataggatttcagaacaatgctatgagggtctgaatgtttgtcccacacgtagggatccagaaaaatcccagctgtggtctggatgactgtccctcacataggattccagaacactgctgctggattctgagtgtttctccctcacataggattccagaacactgctgttggattctgagagtttttcccttacataagattccagaaaacagttatatgggtctatatgtttatccctcacagaggattccagagcactgctacgaaggtctgaatgtttgtccctcacataggattccagagcactgctacaggggtctgaattattctcttcacataggattccagaacactcctgctgttgtctgaatgtttgtccctcacttaggattccagaacactgctgttgggatttgagtgtttgtccctcaagtatgattccagaaccctgctacgtgggtctaaatgtttgtccctcacataggattccagaacactgctacgagggtcctaatgtttgtcctgcacataggattccagaacactcctgctgtgttctgattgtgttttcctcacataggattccagaacaatgctacgagtgtctgaatctttgtcccaaacttggattccagaacccaccagctgtggtctttctgatggtctcacataggattccagaacactgatgctgggttctgagtgtttctccctcacataggaatccagaaccatcctgctgttgtctgaatgtgtgtccctcacttaggtttccagaatactgctgttgggttctgagtgtttgtccctcacgtacgattccagaacactgctacgtgggcctaaatgtttgtccctcacatagggttccagaacactgctatgagggtctgaatatttgtcccacacttaggtttccagaacaccccagctatggtctgaatgattggccctcacataggattctggtacactgcttctgggttctgagagattctctctcacataggatttcaggtcactgctgctggggtctgaatgtttgtccctcacataggattccagaaaactgctacgaggttctgaattattctccctcacataggattccagaacactcctcctgtggtctgaatgtttgtcccttacttaggattccagaacagtgctgttgggttctgagtgtttgtccctcacgtactattccagaacactggtaagtgggtctaaatgtttgtccctcacttaggattccagaacactgctgttgggttctgagtgtttgtccctcacatactattccagaacactggtacgtgggtctaaatgtttgtccctctcataggattccagaacactactacgagtgtctgaatgtttgttcctcacataggattccagaacactcctgctgtggtctcaatgtttgtccctcacttaggattccagaacactcttgctgtggtctgaatgtttgtccctcactgaggattccagaacactgctgttgggttctgagtatttgtccctcacgtagggatccagaacagtgctacatgggtctaagtgtttctcccagatatgggattccagaacactgctacgagagtttaaatgtttgtccctcacataggattccagaacactgctacgagggactgaatgattgtacctcacataggataccagaacactcctgctctcgtctgaatgtttgtccttctaataggattccagaacactgctgctactttctgagtgtttatccctcacataggatgccagaacactgctgctggggtctgagattttgtctctcacataacattccagaactctgctgctgggttctgagtgtttgtccctatcatacgattccagaacactgttgcgaggttctgaatgtttgtccctcacataggattccaggacactactgctgtggtctgaatggttgaccctcacataggattccagaacactcctgctgtggtctgggtgtttgtgcctcacatgggattccagaataatcctgctgtggtctgaatatttctccctcacataggattccaaaacattcctgctgtggtctgagtgtttgttcctcacttaggtttcgagaactctcctgctgtggtctgaatgtttgtcccttacataggaatccagatcactgcttctgggttctgagtgtttgtccttcacataggattccagaacactgctacgagagtctcaatgtttgtccctcacgtaagattccagaacactgctacgaggatctgaatgtttgtctcacacgtaggattccagaacaccctagctgtggtctgaatgattgccccacacaaagcattctacaacagtgtcactgggttctgagtgttgtccctcaaatagaattcagaacactgctacgagggtctgaatgtttgcccctctaataggattccagaacactgctacgaggatctgaattattgtcccttatgtaggattccataacactgcttttgggttctgagtgtttttccctcatgtttgattccagaacagtgttacatgggtctaaatgtttgtccctcacataggactccagaacactgctacgagggtctgaatgttggtccctcacataggattccagaacactgctacaagcgtctaaattattctccctcacataggataccagaactcacatgctggagtctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggactccagaacactgctacgagggtctgaatgttggtccctcacataggattccagaacactgctacaagcgtctaaattattctccctcacataggataccagaacacacatgctggaatctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggactccagaacactgctacgagggtctgaatgttggtccctcacataggattccagaacactgctacaagcgtctaaattattctccctcacataggataccagaacacacatgctggaatctgaatgtttgttcctcacttacgattccggaacactcctgctgtggtctgaatgtttgtccctcactcaggattacagaacactgctgttggattcagagtgcttgtccctcaagtacaattgcagagcactgctacttgggtttaagtgcttgtccctcacataggattccagaacactgctacaagggtctgaatgtttgtcccgtacataggactccagaacacacctgctgtgttctgaatgtgtttccctaacctaggattccggaacaatgctacgaagttctgaatgctagtcccacacgtagaattccagagcaccctagctgtgctctgaatgattttctctcacataggattccagaaccctgctgctgggttctgatggcttctccctcacataggattccagaaaactgctgcgaatgtctgaatgattgtaaatcacaaaggattccgtaacactaatgctctcttctgaatattggtacctcagattggattccagaacacagcagctgggttctgagtgtttgtccctcagaaaggattctagaacactcctacgagggtctgaaagtttgtccctcacataggattccagagcactactgctatcaactgaaaatttgaccctcacataggattccagaacactcctgctgttgtctgtgcctcacttggtattccagaacaatcctgctgcagtctgaacgtttctccatcacataggattccaaaacattgcttctgttgtctgagtgtttgtcccaaaatagaattccaggacactgctgctgggttgtgactgtttgtccctcacaaagcattccataacactgctgccgtcgtctgaatgtttgtccctcagatacaattccaaaacattcctgctgtggtctcaatatctgttcctcccttaggattccagaacaaagctctgaggttctcagtgtttgtctcacacttatgattccagaacgctgctgtgtgggtctaaatgtttgtctctcacataggattccagagcactgctcctgggtactgaatgtttgtccatcacataggattccagaacactcctgttgtggtctgaatgtttgtccctcacgtaggattccagaacactgccgctgggttgtgagtgtttgttcctgacgtacgattccagaacactgctacgtcggtctaaatgtctgtccctcacataggattccagaacactgctccttgggactgaatgtttctccctcacataggtttctagaacactcctgctgtggtctgaatgtttgtccctcacataagattctagaacactgctgctttgttctaaaactttgcccctcacataagattctagaacactgctgctttgttctaaaactttgcccctcacataggattccagaacacttctaagaggatctgaatgtttgtccctcacataagactccagaacactgctattgtggtctgaatgtttgttcctcacataggattccggaacactgctgctgggttcttagtgtttttccttcatataggattccagaacacagctacgagggtctgaatatttgtcctgcacataggactccagaacactccttctgtgttctgaatgtattttcctaacagaggattccagaacaatggtacgaggttctgaatgcttgttctacacgtaggattccagaacaccccagctttggtctgaatgattgtccctcacattggattccagaacactgctgggttcgcagtgtttgtctctcacataggattcgagaacagtgctacgagggtctgaatgtttttccctctcataggattcaagaacactgcagcaaccgtctgaattattctcccacacatgggattccagggcactcttgctgtggtctgaactgtgtgtccctgaattaggattccagaacactcctgctttaatctgaatgtttgtccctcacataggattccaaaacactcctgatttgatctgaatgtttgtccctcacataagattcaagaacactgctgctggggtctggaagtttgtccctcacatatgatttcagaacacttctacgggtttctcaatctttgtccctcacataggattccagaaatctgcttctggcttctgagtgtttttctctcacataggattccagaacactgctatgagggtctgaatgtttgtccctcacataggattcctggacactcctgctgtggtctgaatgtttgtcccacacacagaactccagaacaatgctgctgggtgtgaatgtttgtcactcacacaggattccagaacacccctgctgtgttctgaatgtttgttcatcacatagacttccagaacactcctgctgtggtctgggtgtttatctctcacataggattccagaacagtgctgctgtggtctgaatgtttgtccctcgcataggattccagaacactgctacgaagatttgaatgtttgtctttcacataggattttagaacactgcagcagggttctgaatatttgtccttcacataggattccagatcactactgctgtggtctgaatgtttgtcctttacataggatttcacaacactgctacgagggtctgaatgtttgtcccttaaataggataccagaaaactcctgctgtgctgtgaatgtttattcctcacataggattccagaacactgctgctttggtctgaaaggttgtccctcacagaggattccaaaactctggtacgaggttctgaatgtgagttcctaacataggattccagaacactgctgctgggttctgagtgtttgtacctgcaataagattccagaacacttctgctggggtctgaatgtttctccctcatgtaggattccaaaacagtcctgctgtcttctgagtgtttgtccctcaaatggggttcgagaacactgctatgagggtctgaattattctccctcacataggattccagaacacggctatgagggtctgaatgtttgtccctcacatatgattcctgaatactcctgctgtggtctgaaagtttccctcaaataggattccagaacagtgctgctgggttctgagtgtttttgcctcacatatgattccagaacactgctacgagtgtcctaatgtttgttcctcacataggattacagaacactgctgctgggttctgtgtatttctcactcacataggattccagaacactgctacgagggtctgaatatttgttcctcacataatattccagaacactgccaagagagtctgaatgtttatccctcagataagattacagaacaatgctacgaggctcagaatgtttgctcttcacatcggattccagaacactactgcagtggtctgaatggttgatgctcacataggattccagaacactcctgctgtggtctgggtgtttgtgcctcacatgggattccataacaatcctgctgtggtgtgaatgcttctctgtcacataggattacaaagcattcttgctgtggtctgagtgtttgtccctcacatagggctccagaacattcctgctgtcgtgggaatgtttctccctcacttatgtttccagaacactcctgctgtggtctgaatgtttatccctcacttaggattccagaacactgctgttgggttctgagtgttttgtgcctcacatacgattctagaacacttctacattggtctaaatgctcgtccctcacatagggctccagaaaactactatgagggtctgaatatttgtccctcacctaagactccataacactgctaagagagtctgaatgtttgtcccgcatgtagaattccagaacactcctgctgtgttctgaatgtattttcctcacttaggattccagaacaatgctacgagggtctgaatggttgtcccacacttaggattccagaacaccccagctgtggtctgaataattgtccctcacataggattccagaacactgctgctgggttctgagtgtttgtccctcacataggattccagaacactgttacgatggtctgaatgtttgtccctcaaataggattccagaacactgctatgagggtataaattattctccctcacataggattccagaacactcctgctgttgtctgaatatttgttccccactaagtattcaagagcactcctgctgcagtctgagtgtttgtccctcacttaggattccagaacactactgttgggttctgagtgtttgtccctcaggtacaattccacaacactgccacgtgggtctatatgtttgtctgttacgtaggattccagaacagtgctacgagggtctgaatgtttttctcgcacataggactccagaacactcttgctgtgttctgaatgtattttcctatgataggattccagaagaatgttatgagtgtctgaatgcttgtcgcacatgtaggattccagaaaaccccagctgtggtctgaatgattgtccctcacataggattccagaacactgctgctgggttttcagagtttgtccctaccatagcattccagaacactgcgacgagggtctaaatatttgtcattcacatagaattccagaacactgctactgggttctgagtgtttgtccctcacaaaggattcctgaacaatgctgctgtggtctgaatgtttgtctctcatataggattccagaacactactgctgtggtctcaacgtttgaccctcagatatgattccagaatactcctgctgtgatcagggtgtttgtgtctcacatgggattccagaacaatccttctgtggtctgaatgtttctccctcacataggattccaaaacattcctgctgcagtctgagtgtttgtccctcaaacaggattgtagaacactgctactggggtctgaatgtttgtccctcacataggattccaaaaccctgacaggagggtctgaattattctccctctgataggattccagggcactcctgttgtggtctgaatgtttgtccctcacttaggattccagaacactgctgttaggttctgagtgtttgtccctcatgtgcgattccagaacaatgttacgtgggtctaaatatttgtccctcacataggattccagaacactgctaggagggtctgaatgtttctctcgcacgtaggactccagaacactcctcctgtttcctgaatgtattttcctcacatgggattccagaacaatgctaccagggtctgaatgtttttcccacacttaggattccagaacacctcagctgtgttctgaatgattgtccctcccataggattccagaacactgctgctgggttctgagtgtttctccctcacatacgattccagaacactgctacgagggtctgaatgattgtagttcacataggattccagaacactcctgctctgttctgaatgtttgtcactcagataggattccagaaaaaaggtgctgggttctgaatgtttgtccctcacataggatttcagaacactcttgctgtggtctgaatgtttgtccctcacataggattgcagaacactactgctgtggtctgaatggttgaccctcacataggattccagaacatccctgctctggtctgggtgtttcccccttaaataggattccagaacactgctgctgggttctgagagtttgtccaacacacaggatcccagaactctcttgctgtgttctgaatatttgtcactcatataggattccagaaccctgatgctgtggtctgaatggttgaccctcacataggattccagaacaatcctgctgtggtctgtgtgtttttaccgcacatggtattccagaacaatcctgctgtagtctgaatgtttctccctcgcataggcttccaaaacattcctcctgtgtctgagtgtttgtccctcaaataggattccagaacactggtattgacatcttaatgtttgtccctcacttaggattccagaacactgctgttgggttctgagtgtttatcctcacgtacgatgccggaacactgttacgtgggtcttaatgttagccctccacagaggactccagaacacggctacaagggtatgaatgtttgcctcacacataggactgaagaacaatcctgctgtgttctgaatgtattttcctcacataggattccagaacaatgctacgagggtctgaatgtttgtcccacaaataggattccagaacacaccagctgtgggctgaatgattgtccctcacatgggattccagaacaatgctactgggttctaaatgtttgtccctcatgtaggattcctgaacactactgctggggtctgaatatttgtccctcatctaggattccagaagactactgctgtggtctgaatgtttgaccctcacataggattccagaacacgcctgctgtggtctgggtgtttgtgcctcacatgggattccagaacagtcctgctgtggtctgaatgtttctccctcacatatgattccaaaacatttctgctgttgtctgagtgtttgtccctcaaataggattctagaacactgctactggggtatgaatgtttgttcctctcataggattccagaacactgctacgagggtctgaattattctaccccacataggattccaggacactcctgctgtggtcagaatgtttgtccctcacttagtattcctgaacactgctgttgggttctcagtgtttggccctcacatactattccagaacaccacagctgtggtctgaatgtttgttcctcagatgggattccagatcactcctgctgttgtctgaatgtttttccctcttataggcttgcagaacactactgctgttgtctgaatggttgaccgtcacataggattccagaacacccctgctcttgtctgggtgtttgtccctaaaataggattccagaacactgctgctgcgttctgagtgtctgtcccttcacataggattccagaacagtgctgatatggtttgaatatttgttcctccatagaattctagaacaatcctgctgtaatctgaatgtttgtctctcatacaggattccagactactactgctgtggtctgaatgtctgaccatcacataggattccagaacaatcctgctgtggtctgggtgtttgtgcctcacatgggattgcagaacaatcctgcagtagtctgaatgtttctccctcacattggattccaaaacattcctgctatggtctgagtgtttgtccctcaaatacgattccagaacactggtattgaggtctgaatatttgtccatcacataggaatccagaacactatcacgagggtttgaattattctccctcacataggataccagcgcactcctgctgtggtctgaatgtttgtccctcattaggattccagaacactgctgttgggttctgagtgtttgtccctcacgaaagattccagaacactcccatgtgggtctaaatgtttttccctcacataggattccagaataccgctaagagggtctgaatgtttgtcccgcacataggactccagaacactcctgatgtgttctcaatgtattttcctcacataggattccagaacaatgctaccggggtctgaatgtttttcccacatataggattccagaacaccccagctgtggtctgaatgattgtaccttacataggactcccgaacactgctgctgggttctgagtgtttctccatcacataggattccagaacactgctgctggattctgagtggttctccatcacataggattccagaacactgctacaagggtctgaaccattgtatctcacataggattccagaacactcctgctgtggtctgaatgtttgtacctcatctaggattcccgagcactgctgctgtggtctgaatggttgaccatcacataggatggcagaacactcctgctgtggtctgggtgtttgtgcctccaatgggattccagaacaatcctgctgtggtctgaatgtttctccctcacatagggttccaaagcatccctgctgtgctctgagtgtttgtccctcaaataggattccagaacactgctactgtggtctgaatgtttgttcctcacataggattgcagaacactgctacgaggctctgaattattctcccttacataggattccagaacactcctgctgtggtctgaatgtttgtccctcacttagaattccgcaacgctgatgttgggttctgagggtttgtccctcacgtacgactccagaacactgctacgtgggtctaaaggtttctccctcacataggattccagaacactgctacaagcctctgaatggttgtcccgcacataggactccagaagattcctgatgtgttctgaatgtgttttcctcacatgcgattccagatcaattctaattgtgtctgaatgtttgttccacacgtaggattacagaacaccccagctgtggtctgaatgattgtccctcacataggattccagaacactgctgctggtttttgagtgtttctccctcacgtaggattccagtacactgctacgagtgtctcaatgattgtacttcacagaggattaaagaacactcctgctctggtctgaatgtttgtccctcagataggattccagaacactgctgcaaggttctgagtgtttgtccctcacatgagattccagaacactgatgctgtggtctcaatgtttgctcctcaccgaagtttccagaataagcctgctgttgtcttaatgtttgttcctcaaataggattacagaacactactgctgtggtctgaaaagttgaccgtcatataggattccagaacactagtgctgtggtctggctgtttgtgcctcacgttggattctagaacaatccttctgtgttctgaatgtttcttcctcacataggcttccaaaatattcctgctgtggtctgagtgtttgtccctcaaataggattccaaaacactgctacttgggtctaaaggattgtccctaacataggattctggaacactcctacgagggtctgtatgtttcttccgcacataggactccagaacactcctgctgtattgtgaatgaattttcctcaaataggattgcagaacaatgctgcgagggtctaaatgtttgtctcacaggtaggattccagaacaccccagctgtggtctgaatgattgtccctcacataggattccataacactgctgctgggttctgagtgtttctccctcacataggaaaccaggacactgctactgggttctgaatgattgtacctcacattggactccagaacactcctactgtggtatgaatgtttgtctctcagacaggattacagaacactgttgctgggttctgaatgtttgtcactcacataagattccagaacactgctcttgtgttctgaatgtttgttcctcacataggatttcagaacactcctgctgtggtctgaatggttgaacctcatataggattccagaacactccttctgtggtctgggtgtttgtgccttacatgggattccagaacaattctgctgttgtctgaatgtttctctctcacataggattccaaaacattcctgctgtggactgagtctttgtccctcaaataagattccagagacctggtactggggtctgaatgtttgtccctcacataggattccataacactgctatgaggttctgaattattctcccacacataaggttgcagaacactcctgctgtggtctgaatgtttgtccctatcttattattccagaacactgatgttgggttctgagtgtttgtccctcacgtacgattccagaacactactaagtgggtctaaatgtttgtccctcacatagaattccagaacactgttacgagggtgtgaatgtttgcctcacatagcattccagaacaatgctacaagggtctgaaagtttgtcccacatgcaggattccagaacaccacaggtgtggtctgaatgattgtccctcaaataggattacagaagactgccgctgggttctgagggtttctccctcacacaggattccagaataccgctacgagggtctgaatgattgtccctcacataagattccagaaccctcctgctgtggtctgaatggttataccttacatccgattccagaacactgctgctgggttctgagtgtttgtccctcacataggattccagaacacttctatgagggtctgaatgtttgtccctcacataggattcaagaacacccaatctatggtctgaatgattgtccctcacataggattccatatcactactgctgggttctgagtgtttctctctcacataggattccagaacattactacgaggttctgaatgattgtacctctcataggattccagaatactcctgctttggtctgaatttccgtccctcagatagaatgccagaacactgctgctgggttcttagtgtttgtcccttacataggattccagaacactgctacgagggtatgaatgtttgtccctcacatagaattctagaacactactgctgtggtctgaatggttgaccttcacatagcattctagaacactcctgctgttgtctgagcgtttgtgcctcacatgggattccagaaaaatcctgtggtcatctgaatgtttctccctaacataggattccaaaacatccctgtagtgttctgagtgtttgtccctcaaataggattccagaatgctgctactgggttctaaatgtttgtccctcacataggattccagagcaatgctatgaccatctgaattattctccctcacataggattccagaacactactgctgtggtctgaatgtttgaccctcatatagggttccagaacactcttgtgttctccgtgtttgtgccttacattggtttctggaacaatcctgctgtggtctgaatgtttctccctaacatgggattctaaaatattcctgctgtggtctgagggtttgtccctcaaataggattccagaaaactgtaacttgagtctgaatgtttctccctcacataggattccagatcactgctacgagggtctgcattattctccctcacaaaggattccaggagactcctgctgtggtctgaatgtttgttcctcactaagaattccagaacactgctgttgggttctcagtgtttgtccctcacgtacgattacagaacactgctacatgagtctaaaagtttttccctcaataggatttcggaacactgctgctggcgtctgaatgtttgtacctcacatgggattccagaacaatcgtgctgtggtctgaacgttactcacataggattccagaacattccttctgtggtctgaatgtttctccctcacgtcggattccagaacactgctacgagagtctgaatacttttccctcacataggatttcagaacactgctaagagggtctgaatgtttgtccttcacataagatccaagaacactgcctctgggttttgatcgtttgtccttcacatcgaattctaaaacactgccacaggagtctgaaagtttgtccctcacataggattcaagaacactgctaagaggttctgaagctttgtccctcacataggattctggaaaaattttgctgtggtctgaatgtttgttctgcacaaaggattccagaaaacttctgctgtggtctgtatatttgtccctcacataggattccagaacacccctgctgggttctggctgtccctcacataagacgcaataacccttctgctgtgatctgtatgtttgtccctcacataggattccacaacactgctaggagggtctgaatgtttgtccttcacataggattccagaacactgctgctggggactaaatgttattccttcaaaaaggattccagaacacttctgctggggtctggatgttttctccctcacataggattgcttaaaaatgcttctaggctctaaatgtttgtccatcacagaggattccagaaccgttctgctggtttctgactgtttctcccacatataggtatccagaacactgctgcaggggtctgaatgtttatccatcatataggattaaagaacactcctgcttaggtctgaatgtttgcccctcatataggattccagaacaatgcttctggcatctgaatgtttgtcgctcgcataggattccacaacactgctgctggtttctgagtgtttggccttcacataggattccagaacactgctaccagggtctgaatgtctgtctctcacataggattccagaacattcctcctgtggtatgaatgtttgtccctctcataggattccagaacactgctgctgggttctgagtggttagccctcacaaaggattccagaacactgctaagagggactgaatgtttgtccctcaaatagcattccagaacactcctgatgtggtctaaatatgcgttcctcacataggattccagaagaattctgctctagtctgaatctttgtccctcactagtattccagaacactgcttcaagggtctgaatgtttgtccctcacaggggattctagtacactcctgttgtggtctgactgtttgtcccccacataggattccagaacactgctaggaggaactaaatgcttacccctcacataggtttccggaacactcttaccagggtctgaatgtttgtccctcacaggggattccagaacactcctgttgtgatatgagtgtttctccctcacatatgattccagaacactcctgctgttgtctgaatgcttttccctcacacaggttcccagaacactcctgttgggttgtgagtgtttgtccctctcctaagattccagaaaactgctacgaggttctgaatatttgcccctcacataggactccaggacactgctgctgtgttgtaaatgtttgtttctcacataggatttcagaagactcctgctgttgtcttaaagtttgtcccacacataggattccaaaacagtcccgctgttgtttgaatgtttgtcccttacataggattccaaaacaatgctgctggcgtctgaatgtttgtccctcacgtaggattcaagaacaccgttacgaatgtctgaatgtttgttcctcacataggatttcagaacaatacagctgtgatctgactgtttgtccctcaaatagggttccagaacactgctgctgggttctgagtgtttgtccctcacatcggattcctgaacaccgctgcgagtgtctgaatgattgctcctcacataggattctagaacagtgctgctgaggtctaaatgtttgtccgacacatatgattccagaacactgctaagagggtctgaaggtttgttcctcacacagaattccagaacactgctacgagcatctgaaagtttgtccctcacacaggattccagaacactgctacgagggtctgaaagtttgtccctcacacagagttccagaacactgctacgagcatctgaaagtttgtccctcacacagaattccagaacactgctacaagcatctgaatgattgtccctcatataggattccagaacgctgctgctggggtgtgaatgtttgtccctcacataggattccagaacaatgctgctggagtctatatgtatgtccttcacatgattccagaaccttgctgctgggttctgagtatttctccctcacatagaattccagaacactgcgacgagggtctgaatgtttgttcataacataggattccagaacactttcgctgttgttttaaagtttgtccctcacataggattccagaacactgctgctgaggtctgaatgtttgtccctcgcataggattccagaacactgctgagactgtctgaatgtttgtccctcacatattattccagaacattgctacgattgtctaaatgtttgtccctaacatagcattccagaacaatgctccgagggtctgaatgtttgtccctcacatacgattctggaacactgatacgattgtctgaatgtttctccctcacatatgattctggaacactgctacgagggtctcaaaatttgtccctcacataggattccaaaacactcctgctgtgttctgagtgtttgtccctaacataggattccagaagaatcctgcagtggtctcaatgtttgtccctcacatagggttccagaacactgctgctgggttctgagtgtttgtacctcacataggattccagaacactgctgctatggtctaaatgtttgtccatcacgtaggattccagaacattgctacaagggtctgaatgtttcttcctcacagggcattccgtaacactcctgctgtggtctgaatgtttgtccctcagacaggattccagaacactactacgaggttcctaatgtatgtccatcacacagaattccagaacactgctctgagggtctgaatgattgtccctctcatgttattccagtacactactgatggggtctgaatgtttgtccctcacataggattccagaacactgctacggggctctgaatatttgtcactcacatagaattccagaacccttctacgattgtctgaatgtttgtccctcacataggattccagaacaccgctacgaatgtctgaaggtttgtccctcacttaggattccagaagaatacagctgtggtcggaatgtttgtatctcacatagggttccagaacactgttgctgggttctgagtatttgtacttcacataggattccagaacactgctacgagtgtttgaatgactgtccctcacataggattccagaacacttctacgattgtctgaatgttggtctctcacacagggttccagaagactgcagctgggttctgagtgtttgtccctcacttagaattccagaacactgcaatgatggtttgaatatacgttcctaacataggattccagaacactcccgctcttgtttgaatgtttgtccctcacataggattccagaacactgctacggttttctgaatgtttgtccctcacataggattccagaacacttctacgattgtctgaatgttggtccctcgcataggattccagaacattgttatgagggtctgaatgtttgttcctcacaggggattccaaaacactcctgctgtgttctgagtgtttgtccctcacataggattccagatcactgcaacgagggtctgaatgaatgtgcctcatataggattctagaacgctgctgctgaggtccgaatgtttctctctgacatagggtttcagaaaactgctacaagtgtctgaatgtttgtccctaatataggattccataacactccggctgtggtctgaatgtctgtccctcacacaagattccagaactctgctgctgtagtatgaatggatctccatcacatagcattccagaacactgctacgagggtctgaatgtttgtgcctcaaataggattccagaacactgctgctggggtccgaatgtttgtgctcacataggattccaaagcactgctatgagattctgaatgtttttccatcacataatattccagaaaactgctacgagcgtctggaagtttgtgcctcacataggaccaaagaactctgctgctagaatgcgaatgtttgttgctaacatacaattccagaacactcctgctgtgtctgaatgtttgtctttcacaaaagattccagaacactcctaccggggtcttaatttttgtccctcacataggattcaacaacactgttgctggggtctcaaagtttgtccctcaggtaggattccagaacactgctgctggggtctaaaagtttgtctgtcacataggatgccagaaaactgctgttagtttctgagtgtttctccgtcacatagaattccataacaatgcaatgaggatctgaatgtttgtccataacataggatttcagaacactccagttattgtttcaatgtttgtccctcgcataggattccagaacactgctaagagggtctgaatgtttgttcctcacataggattccaaaacactcctgctgtgttctgagtgtttgtccttcacataggattccagatcaatcatgcagtggtctgaatgggtgtccctcacataggtttccagaacactgcaacaggggtctgaatgtttttccctcacattgcattccagaaaactgctacgattctctgaatgtttgtctcccacataggattccagaacactgctacgagggtctgattgtttttttctcacattggaccccagaactctgttgctggggtctatatgtttctctgtcaaataggattccagaaccctgatacgagggtctgaatgtttgttcctcacaggggattccagaacactccttctttggtttaaagctttgtccctcacacggaattacagaacagtggtacgagggtctgaatgattgtccttcccataggattccagaacactgctatgatagtcttaatatttgtccctcacataggattccagaacactgctacgatagtctgaatgtttgtccctaacataggattccagaacactgctatgaggatctgaatatttgtctctcacataggattccaaaacactcttgctgtgttctgagggtttgtctctcacataggattccagaacaccgctacgacagtctgaatgtttgtccctcacattggatttaagaacactgttatgaagttctgaatgtttgtccctcacataggattccagaacactgctacgattatgtgaatgtttgctcctcacataggattccagaacactgctacgagggtctgaatatttgtcctccaagttggattccaaaacactcctgctgttttctgaatgtgtgtccctcacatagaattccagaacaatcctgctgtggtctgaatgtttgtccctaacatagtgttccagaacactgcagctgggttctgagtgtttgtccctcacataggattccagaacactgctacgagtgtctgaatgtttctctctcacataggattccagaacactgctgctggggtttaaatgattgtccatcacataggattcctgaacactgctacgagtgtctcaatgtttgttcctcaccggggattccacaacacccctgctgtggtctgaaagtttgtccctcacattgaattccagaaaactgcaaggagggtctgaatgtttgtccctcacacagaattccagaacactactacgagggtctgattgactgtccctcacgtaggattccagaacactgcttctggggtcttaatgtttgtcccccacataggactccagaacactgctgcaggagtctatgtgtatgtctttcacatcggattccagaacactgaggccgggttctgagtgtttctccctcacatagattccagaacactgcatcgagggtctgaatgtatgtttctttttatgttatattatttcgtttattattattatacttggaatttatgtttctaacgtaggattccagaacacttccgctgttttttgaatgtttttccctcacataagattccagaacactgctgctggggactgaatatttgtcactcacattccagaacagttctacggttgtctgaatgtttctccctcacataggattccacaacactgctacaagggtctgaatgtttgtccctcagataggatttcagaacacttctacgattgtctgattgttggtccctcacatcggattccagaacactgcgacgagggtctgaatatttgttcctcacaggggattccaaaacactcctgctgtgttctgtttgtccctcacataggattccagatcactgcaacgagggtctgaatgaatgtgcctcatatagtattccacaacactgctgctggggtctgaatgtgtgtccctcacataggattccagaacactgctgctgcagtctactcgtgtgtccctcacattggatgccagaacactgctgctggttctgagtgtttctcccacacatagaattccagaacactgcaacgggggtctgaatgtatgatcctaacttaggattccagaccactcccgctcttgtttgagtgtttgtctgtcacatgggattccagaacacttctgctagggtctgaatgtttgtccataacataggactccagaacactcccgctgttgtttgaacgtttgtccctcatataggattctagaacactgcttctaggttctgaatgtttgtccctcacgtaggattccagaacactgctacaattgtctgaacctttgtccctcatataatattccagaacacttctgtgaggatcgaaatgtttgtcacatattattacagaacacccccactctggtctgaatgtttctcccgcacataggatgacagaatactgctgagagggtctgaatgattgtccctcaaataggattccagatcaatgctgctggggtctaaaggtttgtccgtcacatcggattccaggttactgctacagggttctgaatgtttattcctcacaggggattccagatcactacttctgtgttctgaaagtttgaccctcacgtaggattctggaacactgccatgattgtctgaaagtttttccctcacacagaattccagaacaatgcaacgagggactgaatgattgtctctcatgtaggatttcagaagactgctgctggggtctgaatgtttgtccctcacatacgagtccagaacactgctgctgaggtctgcatgtatgtccatcgcatagaataccagaacactgctgcggagttctgagtctttctccgtcacatagaattccggaaaactgcaatgatggtctgaatgtttgtccgtaacataagattcccgaacactcccgctgttgtttgtttgaatgtttgttcctcacataggattccagaacactgctgctgggttctgaatgtttgtccctcacataggattccagaacactgctacgattgtctgaatgtctgtccatcacataggattccagaacactgctgctggggtctaaatctttgtccgtcacattggattccagaacacagctatgagggtctgaatgtttctccctcacaggcgattccagaacactcctgctgtggtctgaatgtttgtccctcacataggtttccagagcactagtaggagtgtctgattttttgtcctcccataggattccaaaacactgctacgaggttctgaatgtttttccctcacataggatttcagaacactgctgcgagcatctgaatttttgtttctcacataggacaaaagaacactggtgctggggtctgaatgtttgttgctcccataggattccagaacactcctgctgtagtctgaatgtttctcattaacaaaagattccagaacactcctgctgggatctcaatatttgtccctcacacaggattcaaggacactgctgctctggtctgaaagtttgtccctcacataggattccagtacactgctacgagggtctgaatatttgtccctcacataggattccagaacactgctgcgattgtttgaatgtttgtctttcacgtaggatttcagaacactgatacaagagtctgaatgtttgtccctcacatcggattccagaacactcctatgattgtctgaatgtttgtcccttagataggattccagaacactgctacgagggtctgaatgtttttccctcatataggattccaaaacactcctgctgtgttctgagtgtttgtagacacatcagatccagaacactactgttgtgatctgaatgtttctgcatcacaccagattccagaacacgctacgaggttctgaatgacggtcccacacataggattccagaacaccgctgctggggtctaaatgtttgtccatcacacaggattcaagaacagtgctacgagggtctgaatgtttcttcctcactggggattccagaatagtcctgctgtggtctgaatgtttgtccctcacacagaattccagaacactgttacgagggtctgaatgattgtccttcatataggattccagaactctgctgctggtgcctgaatgtttttccctcacataggattccagaacgctgctgctggggtctacatgtatgtccgtcacataggaatccagaacactgctgctgggttctgtgtgtctctccctcacataaattccagaacactgcgacgagggtatgcatgtttgtccgaaacgtaggatgtcagacgctctcgctgttttttgaatgtttatccctcccataggattccagaacactctacgattgtctgaatgtctgaccctcacataggattccagaacactgctgggaggctctgaatttttgtccctcccataggattacagaacactgctacgattgtctgcatttttgtccctcacataggattccagaacactgctacgactgtctgcatttttgtccctcacatagtattccagaacactgctaggatgatctgaatatttgtccctcacataggattccagaacactgctaggatgatctgaatatttgtccctcacataggattgcagaacactgctatgagtgtatgaatgtttgcctctcacataggattccagaacacggctttgattatctaaatgttagtccctcacataggattcctgaacactcctgctgtggtctgatagtttttccctcacataggattccagaacactgctacgaggctctgaatgtttgtccctcacataggattccaaaacactcctgcagtgttcgaagtgtttgtcccccacataggatttcagaacaatcttgctgtggtctcaatgtttgtctctccataggattccagaatacagttgctgagttctgagggtttgtccctcacataggattccagaacactgctacgaggttctgaatgtttgtctctcacataggattccagaacactgctgctggggtctaaatgtttgtccatcacatcggaatccagaccacttttatgagggtctaaaagtttcttcctcacaggagattccagaacacttctgcagtgttctgaatgtttgtacctcacataggattccagaacactgctgctgccatctaaatgtttgtctgtcacataggattccagaacactgctatgaggtctcaatgtttgtccctcacgtagtattccagaacactgctacgagggtctgaatgtttgtacctcacagagcattccagaacactgctatgagtttctggatgtttatccctcacacagaattccacaatactgctacaagggtctgaatgattgtccctctcataggattccagaacactgctgctggggtctgaatgtttgtacctcacataggattccagaacactgctgctgggttctggatgtttgtccatcatataggattccaccacactgctgctggggtgtagatttatgggcgtcacctagattccagaacactgctgcaggtttctgagtgtttctccctcacatagaattctagaacactgcaactagggtctgaatgtttgtccttaacataggatttcagaacactcccgctgttggttgaatgtttctcccttacataggattccagaacactgctcctggggtctgaatgtttgtccctcacataggattctggaacactgctatgattatcttaatacatgtccctcacaaaggattccagaacattcctacgagggtctgaatgtatgtcccacacataggattccagaacactgctgctggggtctgaatgtttgtccctcacatagaataccagaaaactgctacgattgtctgaatgtttgttcctcactggggattccagaacactgctactgggtctaaatgtttatccatcacttaggattccagaacactgctacgagggtcggaatgtttgttcctcacggtggattccagaacactcctgctgtggtctgaatgtttgtccctcacacagggctccagaacacttctacaagggtctgaatgtttctcactcacacagaattccaaaacactgcaacgagggtctgaatgatcatccctcacataggagtccagaacaatgctgctggggtctacatgtctgaccgtcacataggattccagaacaatgctgctggggtctgcatgtctgtccgtcacataggattccagaacaatgctggtgggttctgaatgtttctccctcacatagaattccagaacactcggacgagggtctgaatatttgcctgtaacataggattccagaacactcccactgttgtatgaatgtttgtccctcacataggattccagaacgcagcagctgaggtctgaatgtttgtccctcacataggattccagaattctgctatgattgtctgaacgtttttccctcacataaaactccagaacactgctgctggggtctgaatgtttgtctgtcacataggattccagaacacttttactagtgtctgaatgtttgttcctcactggggattccagagcactcttcctgtggtctgaatggttgtccttcacataggattccagaacactgctacgacgttctgaatgcttgtccctcacacagaattccagaacactgttacgagggtacgaatgactgtgcctcgcatagaattccagaacactcctgctgaggtctaaatgtttgtccgtaacataggattacagaacaatcctgctgtggtctgaaattttgaccctcacacagggttccagaacactgctgctcatttctgagtgtttgtccctcacataggattcaagaacactgtgaagacggtgtgaatatttgtctgtaacataggattatggaacactcccgctgttgtttgaatgtttatcactcacataggattccagaacactgctgctggggtctgaatgtttgtccctcacataggattccagcacactgctatgattatctcaatgtttgtccctcacataggattccagaatactcctttgagggtctgaatgtttgtccctcacataggattccagaacactgctacaaaactctgaatgcttttccctcacataggattccagaacactgctaactagggtttgaatgtatgtccctcccataggattccagaacactcctgctgtggtctgaatgcttgtccctcacatacgattccagaacactactacgagggtctgaatttttgtcactcacataggattccaaaacattcctgttattttcttagtgtttgtccctcacatatcattccagaacaatcccgctgtggtctgaatgtttgtccctcacataggattccacaaaactgctacaagattctgaatggttttcctcactgaggattccagaacactgctcctggggtataaatatttggccgtcacataggattccagaacactactacgagggtctgtatgtttgttcctcacaggggattccagaacactaatgctgtggtctgaatgttcgttcctaacacaggattctggtacactgctatgagggtcagaatgtttgtccctcacattggattccagaacaatgctaccaatgtctgaatgtttgtccctcacatagaattccagatcactgctatgagggtctgaatgtttgtccctcacataggattccagaacactcctgctatggtctgtatatttgtccctcacatatgattccagaacactgctacgagagtctaaacgtttgtccctcacacaggatttcaaaacctttctgctgggttcggagtgttggtccctcacataggtttccagaacaatcctggcatggtctgaatgtttatccctcacatagggttccagaacactgctgctggtttcagtgtgtttgtcgctcatgtaggattccagaacactgctatgagggtctgaatgtttctacctcacataggattccagaacactgctgctggggtctaaatgtttgtctgtcacataggatgatttcacataggattacagaacactgctaagagggtctgaatgtttgttcctcacagatgattccagaacactcctgctgttgtctgaatgtttgttcctcacagatgattccagaacactcctgctgttgtctgaatgtttgtcaatcacataggattccagaacactgctatgaggctctgaatgtttgttcctcacacagaattccagaatactgctaccagggtctgaatgattatccctattctaggattccagaacactgttgctagggtctgaatgtttgtctgtctcataggattccagaataatgctgctggggtctacatgtgtgtccatcccataggattccagaacagtgctgctggtttctaaatgtttctccctcacatagaattccagaacactgcgacaagggtctgatatttgtccataacataggattacagaacactcccacagttgtttgaatgtttgtccctcacataggaatccagaacactgctaatggggactgaatgtttgtccctcacgcaggattccagaacaatgttacgattatattaatatttgtccataacataggattacagaacactcccgcagttgtttgaatgtttgtccctctcaaaggattccagaacactgctacgcgggtctgaatgtttgtccgtaacatatgattcaaggacactcccgctgttgtttgaatgtttgtccctcacataggattccagaacactgctgctgtggtctaaatgttggtccctcacataggattacagaacactgccacgagggtctgaatatttgttcctcacaggggattcgagaacactcctgctgtggtctgaatgtttgtcaatcacataggattccagaacactcctatgaggctctgaatgtttgtccctcacacagaattgcagaacactgcagccaggatcttaatgattatccctactctaggattccagaacactgctgctggggtctgaatgtttgtccgtctcacaggattccagaacaatgctgctggggtctacatgtgtgtccatcccataagattccagaacactgcagctggtttctaagtgtttctccctcacataggattccagaacactgcgatgagggtctgaatgtttgtccgtaacataggattacagaacactcccgctgttgtgggaatgtttgtccctcacataggaatccagaacactgctaatggggactgaatgtttgtccctcacacaggattccagtacaatgttacgattttcttaatatttgtccctcacataggattccagaacaaacctggagggtctgaatgtttgtccctctcataggattccagaacactgctacgagggtctgagtgtttgtccataacatatgattcaagagcactcccgctgttgtttgaatgtttgcccctcacataggattccagaacactgctacgattgtctgagtttcttcctcacctagaattccagaccactgagatgagggtcagaatttttgtccctcaataggattccagaatgctgctgctagggtctgaatgtttgtccctcacttaggattccagaacactgctgctggggtctacatttatgtccgaaacataggattccagaacactgctgctggtttctgagtgtttctcactcacaaacaattccagaacactgcgacgagggtttgaatgtttgtccgtaacataggattcaaaaacactcaagtatttatttgaatgtttgtccctcacataggattccagaacactgctacgagggtgtgaatgtttgtccctcacttaggattccagaacactcctgctgtggactgaatgtttgtccctcagaaagaaagccagaacagtgctaccagggtctgaatatttgtccctcacataggattcaaggaccctgctgctggggcctaaatgtttgtccttcaaataggattccagaacactactacgagagtctgaatgtttgttcctcacaggggattccagaacacttctgctgtggtctgaatgtttgtcactcacatgggattccacatcactgctatgaatgtctgaatgtttgtccctcacaaagaattccagaacactgctacgagggtctttatgactgtccatcacataggataccagaacactgcagctggggtctgaatgtttgtccctcacacaggattccagaacactgctgctggggtctgaatgtttgtctgtcacaaaggattccagagcactgctgctatggtctacatgtatgtccttcacataggattccagaacactgctgctgggttctgagtgtttctccctcacatagaattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattctgctgtgaatctgcctagtcctggacttttttttgttggtaattttttaattaccattcaatctcactggttgttattggtctgttcagggtatctaattcttctcgatttaagttaagagggttgtatttttccctgaatttatccatctcttctaggttttctagtttatgtgcataaaggtgttcatagtagccttgaatgatcttttgtatttgtgtggtgtcagttgtaatagctcccatttcatttcttagtgaggttatttagattttttctcccttttcttggttaatcttgctaatggaacatcattcaaagctgaccaaagtattttttttaactcctgtcaatatgaacctgtgggttccagttcatatccccattggtgctcaaataacaaacttcaagttggtctctggctacttttgacgtgaatctagtagattttttttaatatatatataataagatattccaggttcatttgtatatttccttacccacacttatattcagccatttctccaaggaacccctgttccttgtagtgaatatggcatttgggacgaaagattgaaatgtaaaaatgatgagtattactaaattgattattttctctcaactttttcagtgtccacaactagaaaatatttgcttaaaagataaagtacatcagcgtttctactgataattacaggatttttacttaacctcatatctttttcctaaatctcttttattccttgccaaaaataacagttccttgatgtaattactcattttctttattacctaatgcttgcacaacaatcttggaataatattgccaatactaataacaacagtgtagttattgcaaacaaacttaacaggtttttgaaaaaaacattttggccttgggatagttactttctctgaagttatgcctggatatacagttagattccattgttgtggtggtggttttagtgattttgagagattttaaaaatttaatatttttataagtatgtaaaatatttacatgggtgcaaagtccaagctacagaaaaagatacattcaaaaataatctagtgtctgtttctatcttctctattctattccctccatcctctatgggtcaatttttaaaaaacaaacatgggctgggtgcggtggctcacgcctgtaatctcagcacttttgcgaggctgaggcagggaatcatgaggtcaggtgttcaagaccagcctggccaagatggtgaaaccccatgtctattaaaaatacaaaaattaactgggtgtggtggtgggcgcctgtaatcccagttactcaggaggctgaggcagagaattgcttgaacacaggaggtggaagttgcagtgagccaagatcgctccactgcactccagcctgggtgacaacgtgagactccgtctcaaacaacaacaacaacaacaacaacaacaacaaaaccaaatgtggttgattcttccattatttttttctttttttttcagctacattaaattacaattgacatataataaataaactgcatgtacttaaaatgcacaatttgatgttttgacagaagtccctctttcctgttttctcatctcctctctctctattcttctgtcgttttttaaagtgtaagcaaatatactttcaatatttatatcctggatttttaaaacattgttgcagaacaattgtacacattttcctccactgctttatcgtctcctaacaatatctactggagattaatttatagtagcctatagagacactccttattccttttgacagctgcatagtactccatcatgggaaggcaccacagtttatacaccagtaccctattgaaggacacctgggttgtatccagtgttgttgtagtttttagtttttttcccaaatagaactcttatgaatcgtcttgtgcaatatctttcatatatttacctgagtatctttgagatattttatggaattgggatagctgagtcaaagaataatgctgctagttattgccaaaccttcacaagacaaatacgagcatgcctattttcacatcatctcacttccagagaatgctatcagattttgaatttttgataatctaacaggtgagaagtatcgtaccatattatttcatttctcttactatgcatgagattgagtatatttatatggtggtaaaatatttgcattttattttcccattaggctgttggtctgttttctatctatttccagaagcctttttttcttcttcttctgtcacccaggctggagtgcagtggtgcaatcttggctcactgcaacctccgcctcctgggctcaggcaatcctcccaccttagcttcctgagtagctgggaccacagaccacagatgcatgccacctcgccattttttttttttttttgcttttttttgtttttttggtagagatggggttttgccaagttaaccaagttggtctcaaattcctaacctcaaacaatccgcctgccttggcatcccaaagtgctgggattacaggtgtgagccaccgtgtccagtctcagaagtcttttatatactattaaccctttgtccgtgatattaattgctagttctttttttattatttagtcatttgtgtttttactttgtttatgatggtttcttaccatacattttttttttttaattttactttaagttttgggatacatgtgcagaacatgcaggtctgttacatagttatacatatgccatgatggtttgctgcacctatcaatccgtcatctgggttttaagcccgacatgcatcaggtatttgtcctaatgctctccctccccttgtccctcacccccgacaggctccagtgtgtgatgttcccctccctgtgtccatgtgatctcattgttcaactcccacttaggagtgagaacataccttgcatctttttaattataaataattgtttttaaatatcaggagggatttaattgcaaaatgttcatgcgcaaaatgttccttgaacactctaggagagacgccctttccctgttacagactgtgtgacttcaatctatctgggcctcaagtaccttggatgtaaagaatttagaaaaattgtgtctacatagcagaatccttgtgaagtataaacaagataacaattatagaggactcagaaaattcctgacacatagtaagcactcaaaaaattataactattagtattgtttcatctttcattggaagtgtacagattaaatacataattgttattttgttcactaatcacaccattctctaaatagttgctaaattctttcctatacatgtttcttatttgtcttgtttaagcttctgtaggacagaaattaaacttgatcctttgtttcttttctccatgtatcaagcaaaatatctccaacatacattgtgagaaaaagcagctttcgagtatgagaaaatctactttcaataacacttcagttaaacacattcagtgggtatcttgacttaccaacaaaatagaacaaaaatgttccttatgatccccatctctgaagaacatgccaacaataatttataaagggacctatcatgccaatgtatttttacttgtaaagcaatgaatcattgcattatatctgtttcaagctaaatagagtcaataacatgaaacaggaatttcagtgggatcttttatatctcactgaccagccacaaaattcaaaggaatcacagtgttccttattatacacaagttacctcctatcaccccccaaagatgaatctttcatcacattttcctaccagcattctatgtaatttatttttaacctctttgagagcagaggagatttagtcatcataaaatctattttcaacttattatccaggagtcaaataaataaagaattaatcaaacaatgtcatgtaatgggtctacacatcagaagacacatcagatgaaggaaggagaatgagagctgattcacttggcttaaccaaattggatagctcagaatacaacaggaaaaggaaatgttgccttttctatttatagaaatatttaccagataaggacaactatctaatttactaaaaaacaactgattctctattagtaatgtgcaaaccacaagattattcacatggtcatagtggttctcagcagggtataaaaagcaaaagagagaacaaggagagatcaaactcagaacactcactctcctggaaacccaccgagaacctccaccctctgacaccatggtcaactcctgttgtggctctgtgtgctctgaccagggctgtggcctggagaactgctgccgccccagctgctgccagaccacctgctgcaggaccacctgctgccgccccagctgctgtgtgtccagctgctgcaggccccagtgctgccagtctgtgtgctgtcagcccacctgctgccgccccagctgctgtcagaccacctgctgtaggaccacctgctgccgccccagctgctgtgtgtccagctgctgcagaccccagtgctgccagtctgtgtgctgccagcccacctgctgccgccccagctgctgtcagaccacctgctgcaggaccacttgctgccgccccagctgctgtgtgtccagctgctgcagaccccagtgctgccagtctgtgtgctgccagcccacctgctgccgccccagctgctgcatctccagcagctgctgcccctcttgctgtgaatccagctgctgccgcccctgctgctgcctgcgtccagtctgtggccgagtctcctgccacaccacttgctatcgcccaacctgtgtcatctccacctgcccccgccccttgtgctgtgcctcctcttgctgctaaatctctgctgtgaacacaccacttccttattacgtcctttcctacagatgaaggctctcattgcaaacatgcggactgttcaagagaattgatctgggtcccataagcaaacctcatccttagaaattctgtatttgcattctaccttttgtccaaactcccttccttccaaaggaattcattgacaatctcctaataaattgacaaattgtcctccaacatcctcccacctctttgacttcaggacatttattcatcatgcctaaggaatttgaagattgcctccatcatttgtagggccacagatcttaaagcctccaaccttgaagtccagtgaagtctctctcttaaagtcttttgcaaacatttttgtaccttgttatttccatgtaccaaaataaacctctattctattggcactgaaaattgaatatgattcttattctctttttaaaaagggttttatatttaggtcctgggtgattacatttaactacacctgtagggctcacagcacagattagtcaaccttctaacagaggtcaactgacatcgatcactgcctagtttttttctagaaaagtcttttcaggcttaggcaaatcaattagtcattttgtattctttagacaaaaagagtgaagctgaagtcatgaaatatccatgaatataacaacaggggaaacattttgaaagattgatcacaactcatcatcttttaaaaaataatttcaacttttattttagaatcaaagagtacatattcgtatttgttacatgttgtgtgatgctgaggtttgggctacaaatgattctgtcaccaggtactgagcagtgggtcatttttagcccttcctctctccctctctcccccctttttggagtccccagttgttctcatctttgtgtccatgtgtatccaatgtttagctcccatttgtaagtgacaacatgcaatatttggttttctgttcctggaaaaatttgcttaagataatgtcctccagccacatccatgttgctgcaaaggacaaaatttcattcttttttatggctgtgtagtattccatggtgtgaaaatgtcacatgttctttatccaatgcactgttgatgggcacctagactgattccatgtctttactattgtgcacagagctgtgatcttttaaaacactgtatttcaatttctttttttttccagtaaaagcagctattaggtggtttagcaaagtccatgtattttctactgagtcatgtgtaatgaatcctcaacacaaacacagtggatctccttcattctgactggcagagtttcaatggggagttcatgctgccatgtagagagggccaccttcacggccaggcaggtgatggaaatgaaggaagcaggcctagtgaaaactcacaggtatgctggagactgattttttttcttttcgtccaaagtcatgccctttttttaggatgaaactataaagacccacatttctccccaactagggatgcctctaatgggtcatctcatctccagaactccctataggttcatctgagacttccacggagattgccctgcagtttgatttatcccagtgtcaaacttgatctttctctcactttcccttcctttcccttcccttcccttcccttcccttcccttcccttcccttccctttccctccccttccccttccctttccctttcccctcccctccctttcccctcccctgccctccccagtgttaatcccaagagcatgcttcaataaacctcctgcatattgctctccatctcagtgactgcttcctggggaacccagcctgtcccccaaaacaatttgaaattcatgatagctaatttgagagctcaaatgactgactgaaatgtacttttaatattttagttcctgaaagaaataagaatgtaaacataatagcagaaaatatatttaacagaatatgtagaaaaattatgaattttatataaatcacatttattattttctaaggatgtttagatcatttatacacaaatatatgctctttaaacatttagacaatacaaaagaatgtgacaatgtgaacaaaagtaagtttcccatcatgatctttgccaatcccattcaatacctaatgttgcaaattgagatacatcctcattaaatgcatgcataaaacatgtatgtatttatttgaaaacttggctttcgttgcacatctcttgttctgacatttattcaaacattattttatgtccttccggaaatgttaacattttccttcacaaaggcttggcagatttatttacatatttttctatttactcttgagaactgtgagtacatgcttctttttttttttattatactttaagttctagggtacatgtgcacaacgtgcaggtttgttacatatgtatacatgtgccatgttggtgtgctgcacccattaactcgtcatttacattaggtatttctcctaatgctatccctcctccctccccccaccccacgacaggccccagtgtgtgatttttctccattaaattttagagagaattattgctagtgtataaaaagtctatggattagtataagttcatattttatctgatctcgcgattcacactaatacccagctgactctacaggattttacaggtgtgcaatcatggtggccaagtgcctccagcctcaggcttgtccctggggttcgtccccagctgcccacagtgggggccttaccattaacacaaacactgttgggattttctacctttcctgtcttactttcaccgtttcctcacttgtgcttcctgggatcatcccccaaataaattatgtgcactcaggtctttttctcaaggtttgcattgggtagaatttaagctaagacaacagattatcagcaaacatttttggctgactgatacgaaacaggaaataatagttatttcaatcaacaagagtaaaacgaggaagtcaggaggtgaaggagaaccagtgctaccatctggcgtttacttccttcctgtctttttactgtgtgaatataggcatgcacgttcaacactgtattcttggttatctataaacaagtctcattctataaattgaatcttgacttccgcagtttccacgtatgttatttatcaggtgacatgttacctatcacacaaatgagtttagtcttcctgaaatgaaattatgatttctttgtttgggatgttttcctcccttttatccagaagtcaaaagatatatacattttttaaaggaccttacatgcctctatgtcatcaaaaaaaccttcattcactcaacaaacatttaccaccagtgttctctgtgctgagtatcatggtaacgagaataaatgccatagcgcaagccttcagggtatttgcattgcacgtggtggaaagacagaagtaaatgactatgatacaggagaatgtataaattatgagcacaaggcaggaaatcatgatacatgaatggggtagcttagcaggaaagatattattgaggaggaaatattttaactgggtcttgacacatgagtaggagtttgcagagtggacaaaaaaagatgaaacattccaagaagatgaagcagtttcagcaagcttagcaaattgtattctttacggctttcttggctacactaagacatattaggcttactttctctttaaccttggacaagttgtttgtttgtttgttttaagtttttaatgcttcttttgagtattcccctaaaagactaataagaatataaactagttcataaggttctattaaagcgtgaaaatgaaacaaatgtaagatatttggtacaatgcctgctacatagtcaatacttcacaagtaatatacataccatgagggtgtatggaacttatccacatattatacattttttattttagttgtttaatgaaaataattgtaattcttttcatttctgccaaactgtttcctatccatgtgtcttatgcaagtacctgcaagaaaaagttgagggtttatctgttctacacccagagtacccaatagaacatcttggatgcatgttattgaaggcttaataattctaaatattctttatatataacaaatgcttttgtaaatgaaaaatccatcatgcaattttgatgatcaaagattaatcaggctgggtgttgggggctcatgcctgcaatcccaacactttgggaagccaaggcaggtggatcacggggtcaagagatcgagaccatcttggccaacatgatgaaaccctgtctctactaaaaatacaaaagtaagctgggtgtgatggcgcaaaccaccttactcgggaggctgaggcaaaagaatcgtttgaacccaggaggtggaggttgcagtgagcagagatcatgccactgtactccagcctggcgacagattgagaatctgtcaaaaaaaaaaaaaaaagataaatcaaaacttcctactcataatgcatatactgtaagacatacagcaaaatgtgtttttaccctttaaaggcagtgagtcatgggtaagtactttcgctggaggctgtggaataagatctgacagagtttagaacttcttgggatctgaccatctgcccgaccatccgagatgcacacatgggatcagagtcatcctcattacagatgggacatccttccccaaatgagtgcttccttctaattccttcccaacatttcacctgaccaggacattctttgacaacaaaagatacattcacattataaaaatcatcccccatgatttgcagacagcaatctgcaggtaggagggagagtcacatttaaaaacaaaatgtcagagagtcctgtgaccagtgctttgtaaaagacactgcatagaccagggacaaaggtgactccccactaatgaagaaatatgacatgcatttccaatggaaacacaggagcacagcaggaaaaggaaatgggttattttctctgttttggagtatttaactggaaacacaatgatgtaattacatgattaatttttccagtaggtaaataataacaaggaaataatgatgtggtggcaatgggccttcaggagggtataaagggactacaggcccaggagacttccaaacacaagaacttcactctcctagaaacccaactagatccttcaccctctgacaccatggtaaactcctgttgtggctccgtgtgctctcaccaaggctgtggccaagacctctgccaggagacctgctgccgccccagctgctgtgagaccacctgctgcaggaccacctactgtcgccccagctgctgtgtgtccagctgctgcaggccccagtgctgccagtctgtgtgctgccagcccacctgctgccgccccagatgctgcatctccagctgctgtcgccccagctgctgtgtgtccagctgctgcaagccccagtgctgccagtctatgtgctgccagcccacttgctgccgccccagatgctgcatctccagctgctgtcgccccagctgctgtgtgtccagctgctgcagaccccagtgctgccagtctgtgtgctgccagcccacctgctgccaccccagctgcagcatctccagctgctgccgcccctcttgctgtgaatccagctgctgccgcccctgctgctgcctgcgtccagtctgtggcggagtctcctgccacaccacttgctatcgcccaacctgtgtcatctccagctgcccccgccccttgtgctgtgcctcctcttgctgctgagcccactgccctggctcatctctcccttcactgcaggcccacagttgtagaccattcttctgtgctgactattaggacacatggagtgggattgatgtcattcagcagggtggacttcatgtttccaatgagcccatcaccatcccactgactctgtgagaacattctggttcattttaaactccctcccttgctttctttctcttccagtcatggcaccaaatatgaaataatttgtaatccactagctaagaaattattccaatcctctaaattcctcattttttaaatcgttttgagcctacagaatatccttcccagtgaggtacacattatctccatttcaaacatattatttgtctgtcagcctttcagtcattcttttctcttggaaaggtaggaggctgcccctcccatgctctcctgctttctccctgttctctctttgtctctgtttgttcaagtttgccagaatttttctattttattggttctttatctttattgtgttcacaaaatatattgtattaaacttttcatttagaaatcttttattgttttttgcatttttttgtgataattttcactgagtttactgattcatgggggtgaggtgggaatgcagtagaaggggattctcaaagcatgattccaaagtaagacttcaaggatgaactcatagtgccaaactgctccaatgtcacgcataaactaaaataaaatagaagcttttgattgtttcaatttgatatatggaatgctttgggataggtaaagccccagtattgttgtttgtaagttcatccatgattttagaacttatgatatcatggtaatactcctcactcttctgtgtcaaatttaaaaggcacatctcatcctactgcattccatcttgattcaaatcagttaaggcagactccaaatgttatataagggaattttgttattttgttgtcggtggaccagttcaggttcttgaatttgctgtgcaaaagaatttgagagcaaatccaaagtaagagtaagcgaagaaatttgttgcaaagcaaaagtactctttgagaggcagagtggggtgctcagtgggagagacagcagctagtgctgtaagaggaattccttttatgggagctatacgtacataatcataaaatactggtgaggtcaagtatgcaaaggcagacctgcggttggcacatgtgctcaggatccacgtggtctaacacccatcgcatgtatcattagcatatgaaatctccgccttggggtgtttttcttgttgtggttgtttttactattaaaatgaggaaatggttactataagctgaaccttgatcctagctgtgcatgcaggaccccagagaagtccctgcccaccctcccaaacaccccaccccaggaaggaatttgtagttaggagtttcttgggcttttggtgcaaattggctagagattggggaagctgcatcaggaataaagggcttttgctctctttcccaggttgtactaggtatcaggaacttgtaaccctctggtgggtctgcttcgattctgtaggaccccttatcttgtgaaagagttaggcactgatgcacaaaggttcaagtgaaaagagcttgctgtgaaaggatcctgctgggcttcacacaggggacaagtcagtatggccttgtgaacccccaaaatcggagacaggtctcagtttatttagaaagtttattttgccaaggttggggatgtacacctgtgacacagcctcaggaggttctgaagacatgtgcccaaagtggtcagagcacagcttggttttatacattttagggagacatgagacatcaatcaacatatgtaagatgaacagtggttccgtccggaaaaggcgggacaagtctaagcggggaggggcttccaggtcataggtagataagagacaaatggttgctttctttagagtttctgattagcctttccaaaggaggcaatcagatatgcatttaactcagtgagcagaggggtgactgtgaatagaatgggaggcaggtttgccctaagcagttcccagcttgactttcccctttaccttagtgatttcagggccccaaggtttattttcctttcaaatttccccccttttcttaaaaatctttttgagaaagcctttttgaagaaagtcagtctttggtctcaagtttcatctgatatctcatggctaggattgtttattcctagaaagataattcctgagttattaggaaagttcatttttagcaggttgtgaagtttcatgtcctatgaagagaaaatagggggaggaagggagaaaaacaaaaataaacaaaagaacaatcctggaaaatcaatatgggccacattactctgaagtccatacatcagtaggcaggtatgaaagtggcttatgtatgtaaacaggttgctggtattttcttctgaagtttaaattctctagctccagttcgcagggcttttacaaaagcacagatgagttttcagtgactccaaattaggaaaaatgggggaaagaagaagaaaaaaaaactgaaaacaatcttttgaagacctgtagccaagaaaaattagaattcagtcgaaactgtagaaaataataaaaatgtgaaaacattaggcaagactagaatctaacaacaggtgtattatcattttttgaaacataattcttctctctcccatttcccatttttactaaagacaaatcatggcagggctgattttctttattatacttgacctgattatttgtatacagcgcagccatagtaatactttttttttgcataagcttttaaattgcctttgatggaactgaagcaggatgtttccctgacccctttgtgggacttgtgacgggtgcctcgtttattcagcctgccactctcaactccttgcaggagcgagcatgcaagcaaatgaggcaggaactggagtgcactgtgctggaatcggcactgcagcacggtaggatcaaacttcactcactgggacctgctgcagtcccctgcttgtgggaggaagcatgcaggtgaatcagtgcaggagccaaagtgagtgcttttggccaccggcaggagcaaactctgtgtgggccccacagcagcatctaggtgggggtgcctgcgacccccatagccccagagggcatgttacagtgttcttttaactctgccttccatggatggcttaagtgtcaacagctcagtgaggcctctgcctttttgtgtgaggcagctgccctccaccagcaagggcagagggccagtgtgacagtcttttgtatctgctctcctggctcccaagctcttgtcttgtgtccaggaaaagtgaggtcacatgaaccaatcaaaggatggtaaatgtgggggattttgttgctgatgaaagtggctcttagcagaaaggggagctgaaaaaggatggggtgggtaggtaatcttcctcaaagttaggctgtatccagctggattcttctccaagattacaccatcaagctgtccctctgaatcaagctgcttctctctgacgtccagctgtagttcccaatgtccagctgcttcttgcctctgccagctgagtctggcatcttcacaggcataggatggacaggatggagccatgagtggtttagaaaaaggcaactttcaagcaggaaaacagggatataagttctcactttgggccgtggtttaaggcttttcagcttgaaggtggggttttgtcagagacctacccttttctgcctagaatttctcagccccctgtctctatcagaactttgttccatagaaggaatttcggataagacttttggaaagcttagcctagccatggatttgtaccatcaaatacctatgagttgcatgaattcctctgctcttgaggttccaagataaacttggggctcctggaactgttagaaagtgacatgctttacttaccacaggtcaggaaccctgtacagggactgtgtagataaggtatgaggccagttctcccaaggggcttttattggctccataagtcaaatttgattccttaaaggagagcacaccattccagtcaaagccttggtaaaatgaccaatttctccaattgtgtcttgttacacatgaaaacagattattattgcacttatgcaaataactgtattgccataagttaagaatactcacagatagtttccaattctggggaaaatcaggtagagagaaacaaatatgctccaaatatttttcacaggagtatactaacttgttaaaagctgacaacagctcaaataaaagtttccttgactaaaaaaaggaaaacaaggagcagcaacattttaagcaaaaagtcaaaaagattacgttgctcttctattagttcagttcatgcagttaattcctgttctgcttgctattcatgaacatttcaggtctccatgagttctgaaagcttttcctccattctgatgtcacagtctccaaagttattagaaacttgccttcaagaacacgtgttagagttttatagctgattataaaaccatcttctaaaaaggactaaaacaaaacaattgtccatgggtgacaaaaagttttaggtcagccataatcaaagacacaattgacaagaaaatttgttaccactgtggcacacgataattttatataacaattataattattagtgatattgtacaccatgtcatatcagaattataggagtttcccataattttggtgcacataccaataacatttttatacaaatacagcccaaagaaaaccaaacaccattttatatttgacaatgcttcctgtataatttttataccaaataagtcatttatttcatttttggactttagggaaactaatatcttagaggattaattaggtcagaaaaatacacaacttgtaatttgattctggaaactttgccaaatatcaaaagtttaaaatacttgataggtcatcataaaataagtcaatttttcaaacattaagcccaaataaaacagcataaagccaattaaatttgttttttgaaattttattatcaatctttaaaattttaatcttgaccataagatacagcttccataagccttttttaacctttataacctttattaaggggtcggttaacacttcaagaaaacctttttaatctgatgcaggggcccgtatgctggtattgcatcagtgtgcctttgacatcaattattaacttgcagagaaactgaacttattttgtctctcaaaatcagcccttacaatctcacatgcctacctcttctgtggtagttcctgagccttgaggagttgaatagcttttacttctggccttatgtctcaggaatgcagtttattttgattggcatcttctaccaggcctgaagatgaggttttaattgctgtcagtgcttaagatttagcagaccttggtgtccttgttagacccaggagtcaaaggcctgtaacttaatgtcacaggtactttcaaagcacctacagaaatatacatggatgtaataaccttaattttaaaaaattatctcagatactttttcctgagcaaatcaaaaattaataataacagcataacattgtttcaataagccataaaatctgttaggtcaattacccaaaggcaaaagaaaagaccttctacactgcacagaatattactttggaagaaaacattttctttagacttttagaaaacattgttagcatcagaccataacaaatagaatttaaggaaaataacttatatgagctgcaaacgagttgaaggggagagaaaacagcgagtaaacagttgaactttgggttaaaaaaattaaaatctcttataatttaataagagtaaatcaatcccttaagaaaatttcatcgctctaactattttgtttatcagtgcttttttttttttacatgaagcccaatcttcaggaagactattataatttccttttaattacagacaacttgaccatataaaagtttgttggttttttttttaatcctcttattatgacttttacagactgttcatgatatgcttggactttctggtttgttttgaacatccatctttcttaaacaatcattttattttaggtctaaatttaccatacaagatcttttctcatatgaaattatttctctttaagcttccttaccaaaaagaaccctctttatcctctttatttttatacctttctttacatctctctgatttcctggttccttttaacttgtcttatacataatctttaaataagcattgaattagatgacaattgttcacctttttaaaaaggaattgtttacctagattatttatgaaaactgcaatagtcatcatttaaagttatggaactgccattgcaaaattataactgagacagtgaaaaagatctgacctaattgactccatcttgcttctaacctccaaactgttcttgttcaatcctgggcacaggctgaacagacgttgagaggaacatagtttatagtttacctttgaaacaaagattataacagttcattctcaaactaaatcttactgcctgtggactagaccaccaaaaccacaaaattagaagttacagtaatctcactaaattcaagatgtgactatttttattaaaccaatatcaatgtcttatttattaaagattatacaagcaaagatcattctattacagttttgtaactccatggcaaattttgacaccttatggtatttgacagggataagcatgaaattgcttgattaataaatgcaaacaaaaatgcatgctggcaatttttaagacatgtctaatattactttaccaataattttaaagctagcttatttattaaagattttacttgttacataaacttcagaaagcattcaactagtcttttcttttttcctgataaagtattagattcaagtgctttttatcttaagccaattaattagaactcttttatatattttcagtagcgagaaattgtgtacacatcacataaatatatagacatagtaggcatgctgatagaagtacatcgtatagatacttaaggagcttttttcccctatcttaggctttcaaattcttaataacctgttttactcccctagggagttgtcagctaaatagccttaagtttgcatgttaaaggaaacaactcaggcaaaaatcaaatagcaaaattatatcataaggtacagagagaaaaagtctggtggtgctagagggaagtcaaaatggatttaattgccaattaaacataaaattataaaaattataaaggccttttaaatagatacacacacacacacacacacacacacaaacacacacacagaaatcctatagcttttacttcagaactttagccatgagacaaatacaaattcaccaggttgcaaacaaaaagcctgttgtatccaaacagtggttttgatcttaatagaaaaataacagcagatttaaagcaggcagaaaagaaaatagagaaaaaagagaacttaggaactctgtagtttgtaggttgaccttaaggctcttcttttctttctttttcttttctttctttctttctttctttctttctttctttctttctttctttctttcttttctttctttctttcttgcttgctttctttctttcttgcttgcttgctttcttgcttgcttgctttctttccttcttttctttctcttctaaaaaaaatgaaatacacatgcaggagaacgtgcaggtttgttacataggtatatgtgtgccttggtggtttgctgcacctattgacccatcctctaaattccctcctctcattccccaccccccaacagcccctgatatgtgttgctctcctctctgtgtccatgtgttctcaaagttcaactcccatatatgagtgagaacatgttgtatttggtattctgtttctgtgttagtttgctgaggatgatggtttccagcttcatccatgtccctacaaaggacatgatctcactccgttttatggctgcatcgtattccatggtgtatatgtaccacattttctttatcaagtctataattgatgggcgtttgggttagttccatgtctttgctcttgtaaatagtgctgcaataaacatacatgtgcctgtgtctttatagtagaatgatttgtattcctttgggtatataacaagtaatgggattgctggatcaaatggtatttctgattctagatccttgaggaatcaccatactgtcttccacaatggttgaactaatttacatgggccctttctttcttaatgtaaatatgcacaaagaccatattacttccattttacttaaactctggcaagtacaggtgccataaaacctatggagtgcttgaaagggaatcattctctttgctttctcctcattcttagattatttgtttcccagttttcttcttaaaaagaggaactgagctgaggcttagaggttttctgtggtggatcaatatgtgccatttgtgggcaggactccacagtgggtcaccactgaaaacaacagttcagttcctcatgcaaatgcacacagacaagctgaattgagcttaatttggggagaaaaagcaacagagaagatcctttagaatgcatttgtgaactagaattaggatctttaaatgacaaattcctagaaggaaaacaaaacaacagccaagaccactttttgtaaaccttgctcagccaccccttaactttgtagctctcatctaccactatacacaacaaggtcaaagccaaagaggtcaggtcatgcaatacaggaaaatagaggtttagagttaagaagaatctacccatgactcttgaaactccacaaagaaaacaaaacaccccaaaaggggtgagtggcaacctttgttctgaattctttaagggggttcaagtcattagaagccttctctagactttttggtactgcatatggcaaagggggaggaggtatatggtgcaagaaaagtaaacgaaagaacattcgtgttttaagacaggaagcaaacacagaaaccaagtgcatgggtttttggttctttttgtttgttttcttcttttgcagctgcaatgaattttagccaaattagagaggttttgttacccgtaattttgaattctcacttggatttgaccaagtcaggtagagttggtcaagtctgatgggagaaagaccaaaacaaacaacaaaatctccaaccataggattaccaagcactctaatgataaggagaaattaagagcagctagctggttgttaaactttagcccagacaaagccccagttcagctacttacctagggatgggtctcaggctgaaggctgctttctaccaccctagaagcaggaaaaaaactcaaactggtcttccctgctgggagtgagctcaaactctacatgcctttcatcatcatggaagcaggaaatcttgccttccttgtaaaggaagtaaaagtaaatcttgccttccttataaggaagtaaaagtaaatcttgccttccttataaggaaggcaagtaagcaagtaaaactccaaaaacaaaaataggtggggcagttgtacagcaaaatgaactttagttcttcaccaaatttggggagatcagggattctttggggagggtgctcccagacctcagcaaattgtcctattgatttgagccataaagttagctcatgctattaccaggcaccaacaggatattcgtcaaaggtcaagggcatctccactcagaatcctttcacagttaccaaaatgttaacccagaaaatctgagacaggtctcagttaattgagaaagtttattttgctaaggttgaggatgctccggtgacacagcctcaggaagtcctgatgacatgtgtgtaaggtggtcagataacacttttgttttatacattttagggagacatgagatatcaatcaacatatgtaagatgaacacggatttggtccagaaaaggcaagacaactcgaagcaaaggcgggacaactcgaagctgggagggggcttccagatcataggtatataagagacaaatggttgccttcttttgagtttctgattagcctttcccaaggaggcaatcagatatgcatttatctcagtgagcagaggggtgactttgaatagaatgagaggcaagtttgtcctaagcagttccgagtttgccttttccctttagcttagtgatttggggaccccaatatttattttactttcacagcctcctaaccttatttatcctgcctcatgtttaagaaggcatcataactctatgactgagatctggacaacatttttcttaaggcatctgaaaaaatatgaagcttatttttcatatttgaacatatctgaacaaatcatcttaaacttgattggctcaatagcttaaggccatttcagagctgataatagtcaaataaaagtaaaaacatcaagagcaggtgctcctactagaatgccaagttatagtcacttaccatattctttcagattcaaatgaaggcacctctcttggaaattctaattaggatatgcaccccagctgcgacctactcaagactgaactaattccaataaaataattcttaaaaagaaaagcgagccttgaaattttcatcctttctgggtttatatatattaaaatgttaagtgtggagttgtttaaattataatgtaaacccgtagagaccacagtcagcaatataccatgctatccagatgaactacagctcaatatgcttttttgtctcagcagaactcactgggaaataaagcccactttttgattataaattccaaaatgttgttattgagtaaaatgaattcagtacatgaaattctttatagaagatttcccttctttcattggtgtctaattttcagaaatttggttttatcttttttgtcaaaacagggacgatagtattatgagatataatgtgttaaagataaaatgtgtttcaagagctaaggtatgaattaaaactgtcttaatttaggatattaagacacatgtgcacacacacacacacacatacacacacatatacacacagcacttctattccaataccgtaaattatctatattcgatatagcatgtatcttcaaagtgatttcaacacgggttgcttttcctgcatctttgtgtaaaatataattgtcagggaatcagtaaaataattatgaaagcaatagagaatgataccaatgaattcttatgtacagaaattttattaaaaagcagagatgcaacaaagcataagaaattcacactaggagaaacacagaatataactgggcggctggatctgagggtgcaacctcagtgacaaaactggtcctgcagataatgtctgcctcactgagaagaagatctgtacctcaaagtgataaagaaaatgaggaaattagaggattggaataatttctagctagtggattacaaattaattcacatttggtgccaccaccggaagaaaaagaaagcaagggagggagtttaaaatgaatcagaatgttctcaaagagtcagtgaaatggtgatgggctcattggaaacatgagttccattctattgaatgacatcaaccccacttcctgtatcctaatggtcagcacagtagaagggtctacatctgtgggccagtggtgaagggggagataagccagggcagtgggctcagcagcaagaggaggcacagcacaaggggcgggggcagctggagatgacacaggttgggcgatagcaagtggtgtggcaggagactcggccacagactggacgcacgcagcagcaggggcggcagcagctggattcacagcaagaggggcggcagcagctggagatgctgcagctggggcggcagcagttgggctggcagcacacagactggcagcactggggcttgcagcagctggacacacagcagctggggcgacagcagctggagatgcagcacctagggtggcagcaggtcgtctcacagcagctggggcgacagcaggtgggttggcagcacacaggctggcagcactggggcctgcagcagctggacacacaacagctggggcggtagcaggtggtcctgcaacaggtggtctgacagcagctggggcgggaacaagtgggttggcagcacacagactggcagcactggggcctgcagcagctggatacacaacagctggggcggcagcaggtggtcctgcagcaggtggtctcacagcagctggggcggcagcaggtctcctgacagaggtcttggccgcagccctggtcagagcacacggagccacaacaggagctgaccatggtgtcagaacggggaggatctgggtgggttttcaagagagtgaagttcttgggtttggaagtcttctgggtccatagcctcctttataccctgctgaaggcccattgccaccacgtcattatttccttattatttacctcgtggaaaacttaatcatgtaattacataattgtgtgcttctacttaaatactccaaaagagagaaaataacccatttccttttcctgctgtgctcctgtgtttctattggaaacacttgtcatatttcttccttagtgggggtcacctttgtccctggtctctgcagtgtcttttacaaagcactggtcacatgactctgacactttatttctaaatgtgattctccctcctacctgtagattgctctctgcaaatcatgggggacaatttttataatgtgaatgtgtcttttgttgtcaaataatgtcctggtcagatgaaatgttggaaaggaattagaaggaaggactcattcgggagaaggatgtcccatctataatgaagatgactctgattccgtgtatgcttcttgaatggttggggagatggtcagatctcaaggaagttataaactctgtgtcagatctcattccaccactccaagtgaaagtacttagccatgactcattgcctttaatgagtaaaaacacatttttctgtatgtcttacagcataggcatttggagtaggaagttttgatttacctttgatcatcaaaactgcatgatggattttcattgacaaaagcatttgttatatgtaaacaatatttagaattattaagccttcaataatatgcatccaagacattctattgggtactctgggtatagaacagataaaccctcctctttttcctgcaggtacttgtataagacacatgcataagaaacagaatttggcaaaaatgaaaagaattacaattatgttcattaaacaactaaaataaaaatgtatagtatgtggataatttccacacaccctcagtgtatatatatattacttgtgaagtattgactatgtaccagacattgtgctaaatatctttttcattttcactctttaatacaaccttaaaaagtaggtacattcttattactcttttagcagaatactcaaaagaagcattaaaaagctaaaacaaacaaacaaaatacttgtccaagattaaagagaaagtaagcctaatatgtcttagtgtagccaagaaagcgataaagaatacaatttgctaagcttgctgagactgcttcatcttcttggaatgtttcatctttttttgtccactctgcaaactcctactcatgtgtcaaaacccagttaaaatatttccttctcaataatatatttcctaataagctaccccattcatctattattatttcctgtcttgtgctcataatttgatacattctactgtatcatagacatttacttctttcattcccccatatacagtgcaaataccctgaatgcatgggctatgatgtttctttttgttaccatgatactcagcacagagaacactggtgataaatgtttcttgagtgaatgaaggctttttgatgacatagaagcatgtaaggtcctttaaaagtgtatatatcttttgacttctggataaaagagaggaaaacattccaaacaaggggatcagagtttcatttcaggaaaactacacttatttctatggtaagtaacatgtcccctgataaataacatatgtggaaagttgtggaagttaggattctgtttatagaatgagacttggttatagataaccaggaataccgtgtcttcccactgtggaaggaaaaagagagggtgagacagagaaagagggagtcaaactcatccttttataaggaaccctcttttgtgataacagcattaatccactcatgagggtggtgtcaccatgacccaaacatctcctgttaggcccaacctcccaacactgcggcattgaggatcaagtttccaacacatgaactttgagggacacattcaaaccattgcattccacccttggtcccccaaatccatgtccttctcgtacacaaaatatattcattttattccaatagtcccaaagtattaacttgttccagcaccaacttaaaagtcaaaatgtaaatctaagagtctcatgtgactctgatatgaataagactcaacacaggacttatcctgaggcaaattctcctccatatgtgaacctattaaagacgttatctagttccaaaatccaatggtgggagaggcataggatagacaggcccattccaaaaggcagcaacaggaaagaaaaaagggtaactggccccaggtgagtccaacagggaagacagcattaaatcttaagactggagaataaacttcgactccatgtgctgtctcctggatgtgcccgacatggggaagggctgcctggggtcttggtgttaggccccaaatgccctcagatagccctgccccatggctttgctgggctcagcccatacagcagctatctgattggagtctctgctgcagctctctcaggctagtattgcaggctgatagttctacagttctagggtctcagtggctgctctgaccccccgttttcctgagcatggccctaggaggacctctctgctgtggctacacccctaaggcaggctgtcagaaacatcctttcaaacctaggtggaccaccattgccccacaactcctgcagtctgtgtatctacagtcagtactacatgaacaccaccaaggctcacagtttgtggcctctgcagcagcagcgcaagtctcatctaaacccacttgagccacaactggagcagcaaaggggcaccgtgctagaatgtggagagtaccaaaccctttctgaccttaagattctctcatttggagcctgtgatgggagggacagcttcaaagatctttgaaatgccttcagagccattctcccactgatttgatgaacagcacctagcttccttctattcatatcaatccttgtaacaaagcattacttggccacaatcttgcatgctttttcattctttatatggtcagtctccacattttccacatctttatgttctgtttcccttttaattatgaattccatctttaaatcatttctttcctcttgcattttactatgtgcagttcaaagatgccatgcagccccagtgcttccagtctgtgtgctgccagcccacccaactgctgtcaccccagctgttgtcagaccacctgctgcagaaccacctcctgctcccacagctgctctgtgtccagctgctgcagaccccagtgctgccattccgtgtgctgccagcccacctgctgccgccccagctgctgtcagaccacctgctgcaggacgacctgctgccaccccagctgctgtgtgtccagctgctgcagaccccagtgctgccattccgtgtgcttccagcccacctgctgccaccccagctgctgcatctccagcagctgctgcccctcttgctgtgaatcgagctgctgctgcccctgctgctgcctgcgtccagtctgtggtcgagtctcctgccacgtcacttgctatcatccaacctgtgtcatctccacctgcccccaccccttgtgctgtgcctcccctccccttcccctccccttcccttccccacccgttcccctccctttcttcctttcccttgccctcccctcccctccccgcccttcccctcccctcctctccccagtgttaatcccctccccttccccttccccttctctcccttcactttcccctcccctcccctcccctcccctcccctcccctcatttccccagtgttaatcccaagagcatgcttcaataaacctcctgcatattgctctccatctcagtgtctgcttcctggggaacccagcctgtcccccaaaacaatttgaaattcatgatagctaatttgagagctcaaatgactgactgaaatgtacttttaatattttagttcctgaaagaaataagaatgtaaacataatagcagaaaacatacttaacagaatctgtagaaaaaattatgaattttatataaatcaaatttattattttctaaggatttttatatcatttatacacaaatatatgctctttaaacatttagacaatacaaaagaatgcaaccaaaggtaagtttcccatcacggtctttgccaatcccattcaatacctaatgttacaaattgagatacatcctcattaaatgcatgcataacacatgtatgtatttatttgaaaacttggctttcgttgcacatctcttgttctgacatttattcaaacgttattttatgtccttcaggaaatattaacactttccttcacataggcttggcagatttatttacatatttttctatttactcttgagaattgtgagcacattgttcttttttaaaattattcttaaagtcctagggtacatgtgcacaatgtgcaggtttgttacatatgtatacatgtgccatgttggtgtgctgcacccattaactcgtcatttacattaggtgtttctcctaatgctatccctccctcctccccccaccccacgacaggccccactgtgatttttctccattaaattttagagacaattattgctagtgtataaaaagtctatagattagtataagttcatattttatctgatctcatgattcatactaatacccagctgactctccaggattttgtaggtgtgcaatcatggtggccaagtgcctccagcctcaggcctgtccccggggttcatccccagatgcccacagtgggggtcctaccattaacacaaacactgttgggattttctaccttttctgtcttactttcgccatttcctcacttgtgcttcctgggatcatcccccaaataaattatgtgcacccaggtatttttctcaaggtttgcattgggtagaatttaagttaagacaacagatgatcaacaaacatttttggctgactgatacgaaactggaaataatagttatttcaatcgacaagagtaaaacgagggagtcaggaggtgaaggagaaccagtgctaccatctggcgtttacttccttcctgtctttttactgtgtgaatataggcatgcacgttcaacactgtattcctggttatctataaacaagtctcattctataaattgaatcttaacttccacaactttccacatatgttatttatcagatgacatgttacctaccacgtaaattagtttagtcttcctgaaatgaaattatgatctctttgtttggaatgttttcctctcttttatccagaagtcaaaagatatatacatttttaaaggaccttacatgcctctatgtcatcaaaagccttccttcactcaacaaacatttaccaccagtgttctctgtgctgagtatcatggtaacaagaataaatgccatagcccatgccttcagggtatttgcattgcacgtggtggaatgacagaagtaaatgactatgatacaggagaatgtaacaaattatgagcacaaggcaggaaatcatgatacatgaatggggtagcttagcaggaaagatattattgaggaggaaatattttaactgggtcttgacacatgagtaggagtttgcagagtggacaaaaaaagatgaaacattccaagaagatgaagcagtttcagcaagcttagcaaattgtattctttacggctttcttggctacactaagacatattaggcttactttctctttaaccttggacaagttgtttgtttgttttaagtttttaatgcttcttttgagtattcccctaaaagactaataagaatataaactagttcataaggttgtattaaagtgtgaaaatgaaacaaatgtaagatatttggtacaatgcctgctacatagtcaatacttcacaagtaatatacataccatgagggtgtatggaacttatccacatattatacattttttattttagttgtttaatgaaaataattgtaattcttttcagttctgccaaactgtttcctatccatgtgtcttatgcaagtacctgcaagaaaaagatgagggtttatctgttctacacccagagtacccaatagaacatcttggatgcatgttattgaaggcttaataattctaaatattcttcatatataacaaatgcttttgtaaatgaaaaatgcatcacgcaattttgatgatcaaagattaatcaggctgggtgttgggggctcacgcctgcaatcccaacactttgggaagcaaaggcgggtggatcatgaggtcaagagatcaataccatcttggccaacatggtgaaaccctgtctctactaaaaatacaaaagtaagctgggtgtggtggcacacacctgtagtcccagctactcggaaggctgaggaaaaggaactgcttgaacccaggaggtggaagttgcagtgagccgagatcatgccactgtactccagcctggtgacagagggagaccccgtcagaaaaaaaaaaaaaaaaagataaatcaaaacttcctactcttaatgcctatactgtaagaaatacagcaaaatgtgtttttaccctttaaaggcagtgagtcatgggtaagtacttttgctggaggctgtggaataagatctgacaaagagtttagaacttgttgggatctgaccatctgcccgaccatccgagatgcacacacgggatcagagtcatcctcattacagatgggagatccttccacaaatgagtccttccttctaattccttcccaacatttcacctgaccaggacgttctttgacaatgaaagatacattcacattataaaaatcgtcccccattatttgcagacagcaatctacaggtaggagggagagtcatatttaaaaacaaaatgtcagagagtcctgtgaccagtgctttgtaaaagacactgcatagaccagggacaaaggtgacccccaccaaggaagaaatatgacaagcatttccaatggaaacacaggagcacagcaggaaaagaaaatgagttattttctctgttttggagtatttaactagaaacacacaatgatgtaattacatgattaattttttcagtaggtaaataataacaaggaaataatgacgtggtggcaacgggccttcaggcgggtataaaggggctatggacccaggaaacttccaaactcaagaactttactctcttggaaacccaaatagatccttcaccctctgacaccaatggtcaactcctgttgtggctccgtgtgctctgaccaaggctgtggccaagacctctgccaggagacctgctgctgccccagctgctgtcagaccacctgctgcaggaccacctgctaccgccccagctacagtgtgtcctgctgctgcagaccccagtgctgccagtctgtgtgctgccagcccacctgctgccgccccagatgctgcatctccagctgctgtcgccccagctgctgtgtgtccagctgctgcaagccccagtgctgccagtctgtgtgctgccagcccacctgctgccaccctagctgctgcatctccagctgctgccgccccagctgctgtgtgtccagctgctgcaagccccagtgctgccagtctgtgtgctgccagcccacctgctgccaccctagctgcagcatctccagctgctgccgcccctcttgctgtgaatccagctgctgccgcccctgctgctgcgtgcgtccagtctgtggccgagtctcctgccacaccacttgctatcgcccaacctgtgtcatctccacctgtccccgccccgtgtgctgcgcctcctcttgctgctgagcccactgccctggctcatctctcccttcgccgctggtccacaaatgtagaccattcttctgtgctgaatattaggacacatggagtgggattgatgtcattcagcagggtggacctcatgtatccaatgagcccatcaccatcccgctgactctgtgagaacattctggttcattttaaactccctcccttgctttatttttcttccagtcatggcaccaaatacgaattaatttgtaatccactagctaagaaataattccaatcctctaaattcctcattttttaaaatcattttgagcctacagaatatccttcccaattaggtacacattatctccctttcaaacatactatttgtctgtcagcctttcagtcattcttttcttttggaaaggtaggaggctgcccctcccgtgctctcccgctttctccctgctccctctttctctcactgttcaagtttgccagaatttttctattttattagttctttatctttattgtgttcacaaaatatattgtattaaacttttcatttagaaatcttttattgttttttgcattttttgtgataattttcactgagtttactgattcatgggggtgaggtgggaatgcagtagaaggggattctcaaagcatgattccaaagtaagacttcagggatgaaatcatagtgccaaactgctccaatgtcacacataaactaaaataaaatagaagcttttgattgtttcaatttgatatacggaatggtttgggatatgtataacccctagtaatgtcacagataaactaaaatagaagagaagcttttcattgtttcaatttgatatacggaatgctttgggataggtaaagcccccagtattgttgtttgtaagttcatccattattttagaacttatgatatcatggtaatactcctcactcttctgtgtgaaatttaaaaagtacatctcatcctactgcattccatcttgattcaaatcagttaaggcagactccaaatgttatataagggaattttgttattttgttgttggtggaccagttcagattcttgaatttgctgcgcgaaagaatttgagagcaaatccaaagtaagagtaagcgaagaagtttgttgcaaagcaaaagtaccctttgagaggcagagtgggctgctcaatgggagagacagcagctagtgctgtaaaaggaattcctctcatgagagctatacgtacataatcaaaaagtaccggtgaggtcaagtatgcaaaggcagacctgcggttggcacatgtgctcaggatcaacatggtgtaacacccattgcatgtatcattagcatatgaaatctccgcctaggggtgtttttcttgttgtggctgtttttactattaaaatgaggaaaaggttactataagctgaaccttgagcctagctgtgcatgcaggaccccagagaagtccctgcccaccctcccacacaccccacccctggaaggaatttgtagttaggagtttcttgggcttttggtgcaaattggctagagattggggaagctacatcaggaataaagggcttttgctctctttcccaggttgtactaggtatcaggaacttgtaaccctctggtgggtctgctggtattccgtaggaccccttatcttgcgaaagagttaggtgctgatgcacgaaggttcaagtgaaaagaacctgctgtgaaaggctcctgctgggcttcacacaggggacaattcagtatagccttctgaacccgcaaaatcagagagaggtctcagtttatttagaaagtttattttgccaaggttggggatgtacacctgtgacacagcctcaggaggttctgaagacaggtgcccaaagtggtcagagcacagcttggttttatacattttagggagacatgagacatcaatcaacatatgtaagatgaacagtggttccgtccggaaaaggccgggacaactctaagtggggaggggcttccaggtcataggtagataagagaaaaatggttgctttcttcagagtttctgattagcctttccaaaggaggcaatcagatatgcatttatctctgtgagcagaggggtgactgtgaatagaatgggaggcaggtttgccctaagcagttcccagcttgactttcccctttaccttagtgatttcagggccccaaggtttattttcctttcacatttccgcccatttcttcttaaaaatctttttgagaaagcattttagaagaaagtcagtctttggtctcaagtttcatctgatatctcatggctaggattgtttattcctagacagataattcctgagttattaggaaagttcatttttagcaggttgtgaagtttcatgtcctatgaagagaaaatagggaaaggaagggagaaaaacaaaaataaacaaaagaacaatcctggaaaatcaatatgggccacattactcggaagtccatatatcagtaggcaggtatgaaagaggctcaagtatgtgaaaaggttgctaatattttcttctgaagtttaaatcttatagctgcagttcacagggctttataaaagcacagatgagttttcggtgactccaaattaggaaaaatggtggaaagaagaagaagaaaaaaactgaagacaatcttttgaagacctgtagccaagaaaaattagaattcagtccaaactgtaaaaattaataaaaatggaaaaacattaggcaagactagaatctaacaacaggtgtactatcattttttgaaacaattcttctctctcccatttaccatttttactaaagacaaatcatggcagagctgatttgctttattatacttgacctgattattgtacacagcacagtcatagtaatagtaataatttttttgcataagcttttaaattctctttgatggaagtgaagcaggatgtttccctgacccttctgtgggacttgtgacagggcctcatttattcagcctgccactctcacctccttgcaggagagagcatgcaagcaaatgaggcaggaactggagtgcatgagtgctggaatcagcacttcagtgctgcaggatcaaacttcactcacttggacctgctgcagtcccctgctcatgaaaggaagcatgcaggtgaatgggtgcaggagccagagtgagtgcttttgggtgctggcaggagcaaactctgtgcgggccccacagcagcatctaggtggaggtgcctgcaactcccatagccccagaagtcatgttacagtgctcttttaactctgccttccatggatggcttaagtgtcaacagctcactgagccctctgcctttttgcatgaggcagctgccctccaccagcaagagcagaaggccagtgtgacagccttttgtatctgctctcctggctcccaagctcttgtctggtgtccaggaaaggtgaggtcacatgaacctatcaaaggatggtaaatgtgggggattttgttactgatgaaagtggctcttagcaggaagagagctgaaaaaggatggggtgggtaggtaatcttcctcaaagttaggctgtatccagccggattcttctccaaggttacaccatcaagctgtccctctgcagtcaagctgcttctctctgatgtccggctgtagtccccaacatccagctgcttcttgcctctgccagctcagtctgagatcttcacaggcacaggatgggacaggatggggccatgagtggtttagaaaaaggcaactttcaagcaggaaaacagggatataagttgtcactttgggccatggtttaaggcttttcagcttgaaggtggggttttgtcagagacctatccttttctgcctagaatttccctgtcccctgtccctatcagaactttgttccatagaaggaatttcggataagacttttggaaagcttagcctagccatggatttgtaccatcaaatacctatgagttgggtgaattcctctcctcttgaggttccaagataaacttggggctcctggaactgttagaaagtgacatgctttacttaccacaggtcaggaaccctgtacagggactgtgtagataaggtatgaggccagttctcccaaggggcttttattggctccataagtcaagtttgattcctcaaagaagagcacaccattcaagtaaaagccttggtaaaatgaccaatttatcgtgtcctgttacaaatgacaacagattcttattgcacttacgcaaataactgtattgccataagttaagaatactcacagatagtttccaattctggggaaaatcaggtagagagaaacaaatatgctccaaatatttttcacaggagtatactaacttgttaaaagctgacaacagctcaaaagaaaagtttccttgactgaaaaaaacaaaataaagggtcagcaatgttttaagcgaaaagtcaaaaagattacttcagtcttctgttagttcagttcatgcagttaattcctgttctgcttgctattcatgaacatttcaggtctccatgagtcctgaaagcttttccttcattgtgatgtcacaatctccagagttattagaaacctgcattcaagaatacctgttagagttttatagctgattataaaaccatcttctaaagaggactaaaacaagacaaaaattgtccatgggtgacaaaaagttttaggtcagccataggcgaaaacacaattgacaagaaaatttgttaccaccatggcacaaaataatttaatataacaatcataattattactgataatgtacaccaggtcatatcagaattataggagtttcccataattttggtgcacataccaataacaattttatacaaatacagcccaaataaaaccaaacaccattttatatttgacaatgcttcctgtataatttttataccaaataagtcaaattatttcatttttggacttgagggaaactaatatcttaaaggattaattaggtcagaaaaatacacaacttgtaatttgattttggaaagtttgtcaaatatcaaaggtttaaaacacttgatatgacaggtcatcataaaataagtcaatttttcaaacaataagcccaaataaaacagcataaagccaattaaatttgtttttcaaaattttttaaacaatctataacattttaatcttgaccataagatacaactttcataagccttttataacctttataacctttattaaggggtcagttaacacttcaagaaaaccttgttaatctgacacaggggcccatatgctggtattgcatcagtgtgcctttgacatcaattattaacttgtatagaaactgaacttattttatctctcaaaatcagcccttataatctcacatgcctacctcttctgtgatagttcctgagccttgaagagctgaatagctttgatttatggccttacgtctcagaaatgcagcttattttgataggcatcttctaccagtcctgaagatgaggttttaattgctgtcagtgtttaagatttagcagatcttggtctcctttttagatccaggagttaaaggccggtaactcaatgtcacaggtactttcaaagtgcacacagaaatatacatggatgtaataacgttaattttttaaaaaaattgtctcagtttctttttcctaagcaaaccaaaaattaataataatggcataggaattgtttcaataagccataaaatctgttaggccaattaccaaaaggcaaaagaaaagaccttctacactgcacagagtattactttggaagaaaacatttcctttagacttttagaaaacattgttagcatcaggccacaacaaacggaacttaaggaaaataacttatatgagctgaaaacaagttgaaggggagagaaaacagcaagtaaatagttgaactttgggttaaaaaattaaaatctcttataatttattaagagtaaatcaatcccttaagaaaatttcatcgctgtaactaattatttagtctataagtgttttttttagcatgaagcccaatcttcaggaagaccattataatttccctttaattatagacaactcaatcatataaaagttttttggtatttttttaaaataaatcctcttattatgacttatagagactgttcatgatatgcttggactatctagtttgttttgaacatccatctttcttaaacaatcagtcattttattttaggtctaaatttaccatacaagattctttctcatatgaaattatttctctttaagctttcttaccagcacaggctgaacagactttgagaggaaaatagtttatagtttacctttgaaacaaagattataatatttcattcccaaagtaaatattactgcctgtggactagaccactaaaagccacaagattcgaagttatggtaatctgactaaattcaagatgtggctatttttattaaaccagtatcaatgtcttatttattaaggattacacaagcaaagatcattctatcacagttttgtaaccccatgccaaattttgacaccttatagtatttgacagggataaacatgaaattgcttgattaataaatgcaaacaaaatgcatgctggcaattcttaagacatgtctaatattactttaccaatcattttaaaagtagcttatttattaaagattttacttaagttacataaacttgagaaagcattcaactagtcttttcttttttcctaataagtatttgatttaagtgctttttttcttaagccaattaattagagctcttttatatattttcagtagtgagacattgtgtacacaacacataaatacatagacctagtaggcatgttgatagaagtacatcttatagattcataagaagatttttccactatcttagactttcaaattctcaataacctgttttaatcccctaggaagttgtcagctaaatggctttaagtttgcatattaaaggaaacaactcaggcaaaaatcaaagagcaaaatttatgtcttaaggtacagagagaaaaagtctggtggtgctagagggaaattaaaatggacttcattgccaaataaacataaaattataaaaattataaaggccatttaaatacacacacacacacacacacacacacacacacacacacacatcctatagcttttacttcagaactttagccatgagacaaatacaaattcaccagcttgcaagcaaaaaaactgttgtatccaaacagtggttttgatcttaatagaaaaataacagcagatttaaagcaggcagaaaagaaaatagagaaaaaagagaacttaggaactctgtagtttgtaggtcgaccttaaggctcttcttttctttctttctttctttctttctttctttctttctttctttctttctttctttctttctttctttctctttcttgctttcttgctttctttccttcttttctttctcttctaaaaaaaaatgaaatatacatgcaggagaacgtgcaggtttgttacataggtatatgtgtgccttggtggtttgctgcacctattgacccatcctctaagttccctcctctcattccccaccccctaagagcccctgatatgtgttgctctcctctctgtgtccatgtgttctcaaagttcaactcccatatgtgagtgagaacatgttgtatttggtattctgtttctgtgttagtttgctgaggatgatggtttccagcttcatccatgtccctacaaaggacatgatctcactccgttttatggctgcatcgtattccatggtgtatatgtaccacattttctttatcaagtctataattgatgggcgtttgggttagttccatgactttgctcttgtaaatagtgctgcaataaacatacatgtgcctgtgtctttacagtagaatgatttgtattcctttgggtatataacaagtaatgggattgctggatcaaatggtatttctgattctagatccttgaggaatcaccatactatcttccacaatggttgaactaatttacatgggccctttctttcttaatgtaaatatgcacaaagaccatattacttccattttacttaaactctggcaagtacaggtgccataaaacctatggagtgcttgaaagggaatcattctctttgctttctcctcattcttagattatttgtttcccagttttcttcttaaaaagaggaactgagctgaggcctagaggttttctgtggtggatcaatatgtgccatttgtgggcaggactccacagtgggtcaccactgaaaacaacagttcagttcctcatgcaaatgcacacagacaagccgaatcgagcttaatttgtggagaaaaagcaacagagaggaccctttagaatgcatctctgaactagaattaggatctttaaacaacagcttcctggaaggaaaacaaaacaacagccaagaccactttttgtaaactgtgctcagacaccccttaactctgtagctgtcatctaccattatacccagcaaggtcaaagccaaagaggtcaggtcttgcaatacaggaaaatagaggtttagagttaagaagaatctacccatgactcttgaaactccacaaagaaaacaaaacaccccaaaaggggtgactggcgacctttgttctgattctttaagggggttcaagtcattagaagccttctctagattttttggtactgcggatggcaaagggggaaagaggtatatggtggaagaaaagtaaatgaaagaaaatttgttttctaaggcaggaagcaaacacagaaaccaagtgcacggatttttggttctttttgtttgttttcttcttttgcagctgcaatgaattttagccaaattaaagaggctttgttacccataattttgaattctcacttggatttgaccaagtcaggtagagttggtcaagtctgatgggagaaagaccaaaacaaacaacaaaatgtccaacaaaacgattaccaagcattctaatgataaggagaaattaagaccatctggttgttaaactttagccaagacaaagccccagttcagctacttacctagggatgggtctcaggctgaaagctgctttctaccatcctggaagcaggaaaaaaactcaaactggtgttccctgctgggagtgagctcaaactctacatgcgtttcatcatcatggaagcaggaaatcttgccttccttgtaaaggaagtaaaataaatcttgccttccttgtaaaggaaggcaagtaagccagtaaaactccaaaaaaaaaaaaaaaatagatggggaagttgtacagcaaaatacactttagatcttcaccaaattttgggagatcatggattctttggggagggtgcttccagaactcagtaaattgtcctcttggtttgagccataaggttagctcatgctattaccaggtaccaactggatatttgtcaaaggtcaggtgcatctccactcagaatcccttcagaattacaaaaatgtgaacgctgaatatctgagacaggcttcagttaatttagaaagtttattttgccaaggttgaggatgcttcagtgacacagcttcaggctgctccagtgacacagcttcaggaagtcctgacaacatgtgtgtaaggtggtcagataacacttttgttttatacattttcgggagatatgaggcatcaatcaacatatgtaagataaacacagatttggttcagaaaaggcaggacaactcgaagcaaagccgggacaactcaaagctgggagggggcttccagatcataggtatataagagacaaatggttgcattcttttgagtttctgattagtctttcccaaggagtcaatcagatatgcatttatctcggtgagcagaggggtgactttgaatagaatgagaggcaagtttgtcctaagcagttccgagtttgccttttccctttagcttagtgatttgggggccccaatatttattttactttcacagccttctaaccttatttatcctgcctcatgtttaaggaggcatcataactctatgattaagacctgggcaacaattttcttaaggcatctgaaaaaatgtgaagcttatcaatgatatctgaacaaatcatcttaaacttgattggctcaatagcttagggcacttcagagctgataattgtcaagtaaaagtaaaaacatcaagagcaggtgctcctactagaatgccaagttataatcacttaccatattctttcagattcaaatgaaggcactactcttggagattctaattaggatatgcaccccagctgcgacctactcaaggctatgaactaatttcaaaaaaaaattcttttttttctcaatttatttatttatttatttatttttatgatactttaagttttagggtacatgtgcacaacatgcaggttagttacacatatacatgtgccatgttggtgtgctgcacccatcaacttgtcatttaacattaggtatatctcctaatggtatccttccccctccccccacccccacaacaggccccggtgtgtgatgtttcccttcctgtgtccatgtgttctcattgttcaattcccacctatgagtgagaacatgcggtgtttggttttttgttcttgcgatagtttgctgagaatgatggtttccagcttcatccatgtccctacaaaggacatgaactcatcattttatatggctgcatagtattccatggtgtatatgtgccacattttcttaatccagtctatgattgttggacatttggcttggttccaagtctttgctattgtgaatagtgccgcaataaacatacatgtgcatgtgtctttacagcagcatggtttataatcctttgggtatatacccagtaatggattgctgggtcaaatggtatttctagttcaagatccctgaggaatcgccacactgtcttccacaatggttgagctagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatatgtcttttggctgcataaatgtcttcttttgagaagtgtctgttcatatcctttgcccactttttgatggggctgtttgttttttggtctttgacaaacctgacaaaaacaagaaatggagaaaggatcccctatttaataaatggtgctgtgaaaactggctagtcatatgtagaaagctgaaactggatcccttccttacactttatacaaaaattaattcaggatggattaaagacttacatattagacctaaaaccttaaaaaccctagaataaaacctaggcaataccattcaggacataggcatgggcatggacttcatgtctaaaacaccaaaagcaatggcaacaaaagccaaaattgacaaatgggatctaattaaactaaagagcttctgcacagcaaaagaaactaccatcagggtgaacaagcaacctacagaatgggagaaaatttttgcaatctactcatctgacaaagggctaatattgagaatctacaatgaactcaaacaaatctacaagaaaataattcttaaaaagaaaagtgagccttgaaattttcagcctttctgggtttatatatattaaaatgttaagtgtggagatgtttaaattataacgtaaacccatagagaccactgtcagaaatataccatgctatccagataaaatacagctcaacatgcttttttttctcagcagaactcactgggaaataaagcccgctttttggttataaattccaaaatgttgtttattgagtgaaatgactcgagtacattaaattctttatagaagatttcccttatttcattggtgtctacttttctgaaatttggttttatgttttttgtcaaaatagggacaatagtattgtgagatataatgtgttcatgataaaatgtgtttcaagagctaaggcatgaattaaatgtcttaatttagaatattaagacacatgtgcacatacacacacatatacacacagcacttttattccaataccttaaattatctatatttgatatagaatgtatcttcaaaatgatttcaacacgggttgctcctcctgtgtctttgtgtaaaatataattgccagggaatcagtaaaataattatgaaagcaatagagaatgataccaatgaattcttaagtgcagaaaagtttattagaaagcagagatgcaacaaagcataagaaattcaccctaggagaaacacagaatacaattgggtggctggatctgagggtgcaacatcagtgacaaaactggtcctgcagataatatctacctcactgagaaggagaatctgtaccttaaagtgataaagaaaataaggaaatcagaagattggaataatttcttagctagtgtattacaaattaattcacatttggtgccaccaccagaagaaaaagaaagcaagggagggagtttaaaatgaaccagaatgttctcacagagtcagtgaaatggtggtgggctctttggaagcataaggtccatcctattgaatgacatcaaccccacttcatgtatcctaatggtcagcacagtagaagggtctacatctgtgggccagtggtgaagggggacgtgagccagggcagtgggctcagcagcaagaggaggcacagcacaaggggcggggacaggtggagatgacacaggttgggcgatagcaagtggtgtggcaggagactcggccacagactggacgcaggcagcagcaggggcggcagcagcatgggcggcagcagctggattcacagcaagaggggcggcagcagctggagatgcagcagctgggacggcagcaggttggctggcagcacacagactggcagcactggggcctgcagcacctggacacacagcagctggggcgacagcagctggagatgcagcagctggggtggcagcaggtgggctggcagcacacagactggcagcactggggcttgcagcagctggacatacagcagctggggcggcagcagctggagatgcagcacctagggtggcagcaggtcgtctcacagcagctggggcgacagcaggtgggttggcagcacacagactggcagcactggggcctgcagcagctggacacacaacagctggggcggtagcaggtggtcctgcaacaggtggtctgacagcagctggggcggcagcaggtctcctgacagaggacttggccgcagccctggtcagagcacacggagccacaacaggagctgaccatggtgtcagaacggggaggatctgggtgggttttcaagagagtgaagttcttgggtttggaagtcttctgggtccatagcctcctttataccctgctgaaggcccattgccaccacgtcattatttccttattatttacctcgtggaaaacttaatcatgtaattacataattgtgtgcttctacttaaatactccaaaagagagaaaataacccatttccttttcctgctgtgctcctgtgtttctattggaaacacttgtcatatttcttccttagtgggggtcacctttgtccctggtctctgcagtgtcttttacaaagcactggtcacatgactctgacactttatttctaaatgtgattctccctcctacctgtagattgctctctgcaaatcatgggggacaatttttataatgtgaatgtgtcttttgttgtcaaataatgtcctggtcagatgaaatgttggaaaggaattagaaggaaggactcattcgggagaaggatgtcccatctataatgaagatgactctgattccgtgtatgcttcttgaatggttggggagatggtcagatctcaaggaagttataaactctgtgtcagatctcattccaccactccaagtgaaagtacttagccatgactcattgcctttaatgagtaaaaacacatttttctgtatgtcttacagcataggcatttggagtaggaagttttgatttacctttgatcatcaaaactgcatgatggattttcattgacaaaagcatttgttatatgtaaacaatatttagaattattaagccttcaataatatgcatccaagacattctattgggtactctgggtatagaacagataaaccctcctctttttcctgcaggtacttgtataagacacatgcataagaaacagaatttggcaaaaatgaaaagaattacaattatgttcattaaacaactaaaataaaaatgtatagtatgtggatcagttccatacatcctcagggtatgtatattacttgtgaagtattgactatgtaccagacattgtgctaaatatctttttcattttcactctttattacaaccttataaagtagtgtacattcttattgctcttttagcagaatactcaaaagaagcattaaaaagctaaaacaaacaaacaaaatgcttgtccaagattaaagagaaagtaagtctaatatgtcttagtgtagccaagaaagtggtaaagaacaaaatttgctaagcttgctgaaactgcttcatcttcttggaatgtgtcgtctttttttgtccactctgcaaactcctactcatttgtcaaaacccagttaaatatttcctcctcagtaatatctttcctgataaactaccccattcatttatcattatttcctgccttgtgctcataatgtgatacattctactgtatcatagacgtttacttctttcattcccccatatgcaatgcaaatagcctgaaggcatgggctatgacttttctttttgttaccatgatactcagcacagagaacaccggaaataaatgtttgttgaatgaatgaaggctttttgatgacatagaagcatgtaaggtcctttaaaaatgtatatatcgtttgacttctggataaaagagaggaaaacattccaaacaaggagatcagagtttcatttcaggaaaactacaattatttatgtggtaagcaacatgtcccctgataaatagcatatgtggaaccttgtggaattaggattccgtttatagaatgagacttggttatagataaccaggaataccatgttatcccattgtggaagggagagagggtgagacagagaaagaaggagtcaaactcatccttttataaggaacccactcttgtaataacaacattaatccactcatgagggtggtgtcaccatgacccaaacatctcctgttaggccccacctcccaacactgctgcattgaggatcaagtttccaacacatgaactttgagggacacattcataccattgcattccacccttggtcccccaaatccatgtccttctcatacacaaaatatattccttttatcccaatagtcccaaagtcatgttccatcaccaacttaaaagtcaaaatgtaaatctaagagtctcaggtgactctgatatgaatgagactcaacacaggacttatcctgaggcaaattctcctccatatgtgagcctattaaagaagttatctagttccaaaatccaatggtgggagaggcataggatagacaggcccattccaaaagggagcaacaggaaagaaaaaagggtaactggccccaggtgagtccaacagggaagacagcattaaatcttaagactggagaataaacttcgactccatgtgctgtctcctggatgtgcccgacatggggaagggctgcctggggccttggtgttaggccccaaatgccctcagatagccctgccccatggctttgctgggctcagcccatacagcagctatctgattggagtctctgctgcagctctctcaggctagtattgcaggctgatagttctacagttctagggtctcagtggctgctctgaccccccgttttcctgagcatggccctaggaggacctttctgctgtggctacaaccctaaggcaggctgtcagaaacatcctttcaaacctaggtggaccaccattgccccacaactcctgcagtctgtgtatctacagtcagtactacatgaacaccaccaaggctcacagtttgtggcctctgcagcagcagcacaagtctcatctaagcccacttgagccacaactggagcagcaaaggggcactgtgttagaatgtggagagtaccaagccctttctgacctgaagattctctcatttggagcctgtgatgggagggatagcttcaacgatctctgaaatgccttcagagccattctcccattgatctgatgaacagcacctagcttccttctattcttatcaatccttgtatcaaagcatcacttggccacacccttgcatgctttttcattctttttttaaaattttattattattatactttaagttttagggaacatgtgcacaacgtgcaggtttgttacatatgtatacatgtgccatgttcgtgtgctgcacccattaactcgtcatttacattaggtatatctcctaatggtaaccctcccccctccccccaccccacaacagtccctggtgtgtgatgttccccttcctgtgaccacgtgttctcattgttggtcaggtggcacattttctacatctatattctctgtttcccttttaattgcgaattccacctttaaatcgtttctttcctcttgcattttactatacgcagttcaaagacaccaatcagctccttcaacatttttcttggaaatttcttcccccgatatacttgttcatctttctttaactctgccttccgtaaagtctttagacatgaacataattcaatcaagtcctttgccactttgtaacaaggatggcctttactccagtttccaattcttgttcctcatttccatctgagatctcatcagaatagcctctattgtccatatttctctcagcattctggccacgaccacctaaataacctataagaagattcatactttccctacagctattattttcttctgagccctgaccagaatcacccttaatgctctcttcatagcattacagtattccttccctatctgtggatttactttccatggtttcagttacttatggtcaaccacggttctaatgtattaatggaagattccagaaataaacaatttgtaagttttaaattgcatgccattctgagttgtatgatgaaatatcaccaatcctgctctgtcttgcctgggacaaatgtcctccctgtgtccatactgtatacatgaccaccctttaatccccgagtaattatctcagttaccagactgactgttgtagtactgtaggatatgcagtgcttgctttcaaataaccctcattttacttaatgatggccccaaagtgcaggctacactaatttggttgacttggactttagaaaataatgtcacttaatgctattccaccataaaatcataataaaatcatgtattttgcagcaacatggatggaactggagatcattatcttaaatgaaacaaatcagacacagaaagacaaatatcgcatattctcacacatgggggctacataatgtgtgcacatggacatagagagtagaatgatagaccatggacactcagaaagcttagagagtgagagtggggttgacaatgagaaattacttaatgggtacagtttatgttactcatgtgatgatggcctaaaagctctgacttgctaattatgcaatctatgcatgcaacaaagtcacacttgtacctcaaaacttaaaaaatgaaataaaataataatgtcatttagcttcttcccaatacatttaaacataattaagcatcatagctaaagaatgcttctaagtgatgaggttcaaggctcaagtacagaataatatgattcacttgcaattagcacaaagtacattcacgctaggttaaatatatcttctgtaattacatttaccttcccaatttgtccatgaattttgtggaagatgccaattttccctcggtacaggccagggaaaattagcctgcacatgtcccaaattaataagattttgttgtatgatgatcaattatagcaagaaatttaggaagcgtaggagatattcaggacattgtcctaattcttttctatgatgtaacctgatcatcagaatttcaggtaatatgttagtcaagtaatgaattattgccccaacatacaatactcctaggaatacataatgccaatagaatagaatagagcaaaagtgaatcactaatgccacagtcttcaatgttcagaatattcacagggtcatgtagggatcggcttagggccttgaagagccctgtgtgactcacaggtgggatcacaatagcaggtccatgtgtgcagatgagctttatattggtcagaaatgttcttttggaaggtctttgttgggtttgatataatcggaaattaggagtcctatacagctatagatcatcattcacttatctattcaacaatggtgagaactctctcattctgttctacagactgtgcaggaacctccattctacttgttctttaagacttaggtgctattacctccacaagcaaacctttcctgatgctctctgcccaagccacctctcccttaagttgccctcttctaagatcctggcagcatgtttctcatgtgtttcatattgttgaatttattgttagctttttgaaagctttttggagatataattgacaagtaaaaattgcatatattcaaggtgtacaaaataatgttttgatatacatatacattgtgaagtagatgaccacaatcaaactaattaacatatcaatcacctcacatagttattctttttgtggtgaaaatacttatgttctagcaaatttcaagtgtacaatacagtattgttaactatagtcacattgccatacattcaatttccagaacttactgattttggatagctgaaactttatactctttgaccaacgtctaccagtttcttcctcattccaccccatgcaaccaccatataagtcagatcatgcagtatcggtctttgtgtgtctagcttatttcacttagcttaatgtcctctgggttcatccatgttgttataaatgacaggattttcttccttttaaaggctgaattgcattttgaataatgacatttatatacattttctttatccactcatctgtggatgggcatatagatatttctgtatcttagtagctgtgaataatgctgcaatgtacatacaagtgcagatatcttcaagatagtgattttatttactttggatatgtatccagaagtggaattgctggttcacaggtgagttctatttttaattttttgaggagcctccatactgttttccataatggctgcatcaagttacattcccaccaacaatgtataagagttccctttacaccacatccttgccaacacttatcttttgactttttgataacagccatcctaacaggcatgaggtaatatcttattgtggttttcattatcacttccctgatgattagtgatgttgagcaccttttcaaagactacatttgacagtaatttagaattctcaggtcaattgggaagttggaacacaaagggagaggaagaatggtggctgttggatagagagggatgtaagagctaaattctcatcacacataacagtgggccaatagataatatctaaactttaaaagtcaagaaatagtactgtaaccacaccatttagaaagatcttttttcctagagttctccctccaaaatcttcatcttactgttctcctctgcactgattgctttctaggcttgctgtacggttgccatttttggatttaccttgaatgcaattctgattttctgacttgaaattcctgttttctgaatctgtgttctcctctttgtcaacttcttcttcatgttggtggtgcacatcctccagacgttactttagaaagggttcacggacaataaggatttttttgggcttttcatatctgaaaatgttactattcctttgtttctgtttggtagtttggccaggcatggaattctaggctaaaaaacatcccactgagaaattttaaggcatttcccattgtcttctggcttccggtgttgatgttgaaaagtgtgatgccatttcgcctcctgaaccttggtatgggaaccacatattattttcctcattggacgcttttagtaccattttcatatccctaatattctgagatttcacagtgatgtatcttgatgtaagccttacattcactgttctcagcgctggtggtcttttaatctggagctcccttctgaaagaaattttcttatactatttctttgatagttttctcccttgtatttccttccttccttcttctttccttccctccctcccttcctctttctctatttccctttcttcctgtcttccttcctttctttttcttccttgtctttctttcttttccttccttcctctttctctttctttctctcctttccttcctccctctcttctttccttccttcctccctccttccttcccttcttccttccttcccttcttccttccttcccttcttccttccttctcttccttccttcccttcttccttccttcccttcttcctttcttcctttctttctttctttctttctttctttctttttctttctttctttcttttctttctctttctctctctctctttctctctctctttctttctttctcccttcccttcctgtcttcttttttccttttgagacaagacttctctatgttgcccaggctggcttcaaatccctgggcccaagggaccctctcacctcagcctcccaagtaactgggactataggcacaggcaaccattacacctgactccttatgttttctcatttgtctttctaaaatttttcttcattgagtggtagatctcctgaattgatcctctgtgttattatagtttctttaatgtccatttctttcacttctttttataattttttttacatatcttcaagacaggagaacaaattatttgactccttgttctactttaccttccaaacattttactgaacgtttttctaattttttctatcacattttaattctcaagctttcactcaacttctctgactgctcctgtttcttagaatcttgtttttatttcaaacagaatttcttctcttagctctcttgagtattttatttacaatagttcttgttttacaattttttagttctattctgctccctgtagtttctattcctgtcaaatttgtttttccccctttttctttttttctttttaaattagtgtgaattgtcaggctggagacatttcccaagtgtctgaagcatattggttaacatggcactaaaaagccaattgaaagttctgtgtggacagcagggcttgttaattgatctcttcacctctcctccccttcatccacaaaaaagaagtcaagatttatatgtttagtttctttagaggagaatcttccaatatcctgcttggaaagcttatggccatcagtcctggatgctgagcacagtgctcagattttcactgcatgagtctgttttctgttctattcttgacttttgttcactttagtattcccaaatctggagtctctgtcactaaattttctggaagataacccttgtttctcctggttggaagtgggggaggcctaatgaccaactttgtagggtggggtagggatccaggggtcgaagcatcctgctgcctaccctgccttcaggtgtattacctggtgactccgggttctgagcctttctgaggattcaaggaaaaccaactttacactctgtggtactctctctgtatgcattcacattgtagctccttttgttatctttagttgaccaccattgctcttgccccaaatttgctacactttcttatctgctattgtctcctgtcctgagaaagtaagatgagggtttctgttttttaacaccttttaaaagttggtgtatcataatggattcaaagaggataagaggacataaaagttaattttctgacattttaaggacctgctattactaaactgttaaaattagacttagtatctcatatatacactcccccttaagtgttcctgaagtaaactagtgcccatgctccagatgttggtgagattctttctctgtgtttccaaagcatgttaaataatcctgaaggttaattttattttccaatattttattcacgcctaaactgcattgaagggcaaaaaaaattgtggcatgcctgtggtcccagctacttgggaggctgaggtggcaggatggcttgagtccaggagttggagcttgcagtgagctgaaatggtgccaccacactccagcttaggtgacagaatcagaccctgttattttgatccacacaagctattggtcatgtgtgaaggcaatggaaagatttcctcatagattcaaggactcgggatatataacttccctttaaaattcctttaagaaatattcccattgactgaaatacaagtcaaaataaagaattccattacagtatagatgtcatgcataaaataatggttctgagagatgaagctgataaaatttaaaaagattcaaatatattctaaaagtggtaggggataaaaatagcaaagaatacacaagtggtaggcaaattaaaaaatggggtaacaatacctatattttctggtaataaagtgggtgtggtggcttgcacctgtaatcccagcactttgggagaccgaggtgggtggattgcttgagctcaggagttcaagaccaacctgggcaacatagtgagaccctgtctccacaaaaaatacaaaaattaactagacatggtggtgcatgcctgcggtcctagctacttgggaggctgaagtagctaggggaggttggcttgagccgtggagttgaattttgcagtgagctgacatggtgccactgcacaccaacttaggtgacagagccagatcctgtcttttaaaaaaaggaaaaaattcaaaaatgaagataacatatttataaatgtttatgtgccatagaagagatcatagaaatgaataaaacaaatacagttttgcaatatgcagatatgacagaataggcatcattactagtttgaggctctgatagatttctcaggcctaggtacttaagcaatactgaaacgagaaacagcttgtatagaccatttatggtcctggaataaattgaagagggatgcctgagcccaaagatacgattctcacgtcgcattaccatatcaatttctgaatatgttgttttgagttttgtgcttactttacttttttattttcctcttcagctaaaagttttgcctagagctcttgagcctactgatatcattttgattgatatcattttgaaatggaaggaaatggcttgaaaagacacaggaaatacaatatgaactgaactcccaatgcaaaagggaatctcaaagttataaaggaaacacaggtagctgggtgacttgatccaggtcatgtggagtgagccctaacctttgcatgtctcataggtagacctgcatgcaaattctgcaattggagctttaatggagcatgagtggatgaatatcattaatgggtcagtgaagcatctcaaaaatagaactcatctgcaattccaatttggtttccatcactttctttcccataatgacgtgtttcatcactcatgctcgctgattttcccactgactctatggcttcagcctaaaattatgcctcttatttttccatagaactcaccatgaattaatcttgacatatccctcctccttaaaaggactataattttttaaatgtctttttaataagactacccttcataaagatataaatattcggctgtgatctgattctccttcacataatcttacgtgtttgagacctgtgcatgttaacctgaattttcagaattgacacattttatttctatgaatcaatccttacgtatgtattacttttctccaatagaatagagtcctttttctcactaatattaccaacatactctccctgacatatgcatttaaattaaattcatgattaattgaattaattgagtggagagggaaaggaaagaaaaataactttcagaccacgtgtggtggctcaagcctgtaataccagcactttaggaggccgaggcaggtggatcacctcagttcaggagttcaagaccagcctgatgaacatgaagaaaccccgtctctactaaaaatacaaaattagccgggcatggtggttcatgcctgtaatcccagctacttgggaggctgaggcaagagaatcacttgaacccgagaggcagaggttgccatgagctgagatcatgccactgcactccagcctgggaaacaagagcgaaaccccatctcaaaaaaaaaaaaaaaaatccatgattatgttgtgagttacctaagggaaaagaagtgggtctcattcattttatgcaattcccagagcccaatagcttgctaatttgttcttaatttaattacagtaaaaattgagttcttgttttgtctcaataaacttgatggcaggtaaagtgagcaatctgttttggattaaaaaatgaattatttggcattttctctaatacaggctttggctgatacatataatatcaatttttttgttattgcccatacaataggaactcaaaccattttacaaataaataatcaacagtaagaaatactgaaaggtcacaaatgtttttgataccaagagagtgtttattgagatatagttactctaccagacgtaattcattgcaaagtccagaccacactcggcaattgtaagcttagaagcctgttccaatgaaatagtgtgagatatctggtcatctgactgcacaccaagcatagaagttggaggttttgtacgatatgcatttaaatttttgcttttaaaatagttgcttggtggaatgaacaatgagctatataaatgtagtggtggatcagggcaaggccaggtccagtggagaaggggaatgagaatgactggtacactgacaacaaggtggttgaaccagggctggtggtcaggaatgaagttcaacagcaagaggattcataggagactggaccacagcaggtggtctggtagcagactggacagcagcagctggacacacagcagccagggtggcagcagctagaagtgcagcagaagggtggcagcaggagggctggtagtactggggattataacagctgggcctggagcaggtggacacactgcagcttgagtggcagcagctagaaatgcagcagctggggcagcacagggactggcagcacgggggcctgcaacagctggacacagagcagctgggatggtagcagatggttctgcagtaggtggtctggcagcaactgcagcagcagcaggtctggcagaggccttggccacagctctattcagagcagacagagctacaacagaagctgaccatggtgtcagatgagaatcgcagatgacgagcagaaggaggcacttcttcctgtacaatgtgtctccatgtggttcaaggaagtagccacactcaccaagcaacaagataaatggtctttgacccacacaagattcaccggaaatactgatatcctttcaagtcactaagtctttggtctttcccgccttgtaaaaaagcttggctctttatgccgtacttcacagagccctactcctgattcatcttcttgagaatacaaagtcgcagttatatttgaatttaggccacagtcttatggatggaattgcacccagcaaggagttgatgagaaggtcatggccttggactcttcttggcatcttcctagaacatctcaggcagttttgtttttaataaatatagatttctaggcaatgctcttggatatgctgtgtcacttgattattatcctgagtagctgggattacaggcacctgccaccatggccagctaatttttgtatctttagtagagccaggatttaaccatgttggccaggctggtgttgaactcctgacctcaaatgatcagcccacctcggcctcccaaagtgctgggattacaggcatgagccaccactcccatcccaaaatagaatttctaatgaaatagacataatctaatttgatcttctagaagtcttttccaagcctcacacaaagattattaaaataattgattctctactttggtagattagattattccttattaatgtttactctcccccctcctcccacccaactccagaagtatcctctcccaccctctgacttggactttgccatgtgagttgctttgaccaatgagaaggcatgacccgaagactcaaaatgtgagattgttcccttgggcctttgttctcagaggaggatggcccctaaaataccggacactccattaaaatggaattccagacaaacaacaaataatttttaaatgtaagtatacccatgcataatcagatataattgtaataaaattatttgttgtttttctgaaattgacatgtaactggggaacctgtatttttatttgctaaatatgacaactctcattcaaaagaaagtcccaaaccaacctgtgggcagaagctaaggccaaccttaatcaaccaaaccccaactaacctacaaatatatgaccaataaataaatacttgttacaataagctatgagagtttgtggttgcttgctatgcagcaatagctgtctaattcaaccatggtagcaatgtgaagccagcttaatacaccaatcaatacacaaggatgaacagatggctttctacaaagaaaataaaaatagaacagtggccaagtatttgtgacagggttggttttatggtaaattttgataaattttctggaggggatagttagttaaatttttagctttatcaatataatgaggattaatggatagtgcaaagtgagcctattcaaattaattcaaaggagaatctcattttcataagcctatttgtgaaaacacagctttcgatttagacatgcttggatttgaatctagactgttatctaagagcctacagttcaatgctgttctggtcaggctatggcagaagctcaagctggaagagtgcttcacaaaggagcctcaggctcagcccgctgccctcccacagaggaatggcaggtgccagcccctttatactaggatgaaggccaaggtcccagaatcccaagggcctttgcccctatctgatggcttccgctacgccttgacttgtgcagacacctgcatggggctactgtaggtgtatcccagcaagtatgttacccagaaaaccaccataaaaagactggagttatatgtagcctgtggcgtccccactgatatcaacagtgcccagggctctcactttaccatatacaaagtgcaggaatcggtggaggccctggatatccattggcatttctacctgccatacaaccctatagcagcggggctgattgaatggatgaaacaaccattgaagaaacaactctggcaggagacgccctctctggctctgtggacacactgcttaccagcacccatctgcgccctgaatgaaactatccaaattagatgtatcactttgcaaaatcacatgccctggacgcttagtgtggatcttctgcattaattaaaactgaatgttgtgtatatatatccctgattactctcacaatgtaactcaggccgtgcaggcccaagatatccctgaattaacaggtgtgctctcatctccccagtgcacacactcttctggctcaaggacctgataccaccatcacgatccaggttgacagtgtaagggatggtacccccctcctttgcctcaacctgggactcaacctggggctatgcccttgccataggacctacccactggagagcacatcattacatgggcccggaaatcacaaaccagccccagttggtacagttttttcactccatggggcaagggcgtagaaaatgatatacagatcacacctattttacatcctattcctccttgtacttctaaaataatcaatcctagtccccacttgtgcaagggagtgatcatcctgtcattatgggacattacaatatccacactgtcttactgtggctgcaacgtgttgcagaagtgggcaatccatgtggtattgcaaaccaggcacaggttgctgctgggggtggtgatctctcagaacgacacaacttcctgtcttgttagatggcctgacttgccctttcttcttttttttttttttttttggagatggagttttgctcttgttgcccaggctagagtgcagtggcatgatctcagctcactgcaatctctgcctcctgggttcaagagattctcctgcctcagcctcccaagtagctgggattacaggcatgcaccaccacgcctgcctgatttttttgtatttttagtagagacagggtttcaccatgttggtcagctggtctcgaactccagacctcaggtgttccacacgccttggcctccaaaagtgttgggattacagacgtgagccactgtgcccggccaacttgcccattcttctacccactaggtatctcacctgtcacccataggtggtgtacctcttcaccaactgggtgcaaatggcgacctttccccaaaacaaaacagactgttgcatctgcagggagctgcccttctcctccagcatcagcctgccatggtgcatccaagcagctaacctcagtatctggagccatttctatacttggtataatgaccctcacccatttccctttagcaataaccacacttcatgtgataagtttcccaccatcagagatgagacaacatattttccacctagtataggagcaggttaatgtcacccccactgtggggtattctgtagatgatgggccagggtggacaacagcagtatagatacagcttgtgggctgtgcacccacatgtattaaaaggcatgataatagcatgccacaagctaaaaccagtagtatgggatggctacccccacagtgtaatgtaatctatttcttcaggtaatagacatggaatatgacagcaatgaaaccaatctcttcaggtaaccagtgatacttgactgcgacgacagagtgactctccacctgggggcctaccacaccccttaggatggctgtgggcatgcggcatccacagttggccttacttaccctataactggactggtagatgcacctggggacatcctcatttgctgggatacatcgtgcccagtttagacaccattcttactaactgggaaattgtaaaagccaggcactgctggaagcatgcatccctgtggttttacccgttggccacttttgccatgtccccccccccactccccccaccactcaccacccaagtggtgacaatagacatacagctgcaagttgaggccctggcttaacatagggctgcagtctttaatgatatctgccatgatattactcttctcactgaagaaactgcccaaattaggtgtgttactttgcaaaattgcatggcccaggacatcttaaccgcttatcagggcagaacctgtgcattaattaaaactgaattttgtgtatatatccctgattactctcacaatgtaacacaggccatgtgggccctagatacccagatttctgctatagaatctctatcttatgaccctgtaaccacatggtttaatcaactcctgagtgcttggaaaaactttctatacagtacaattgttgttacattcattattcttttttgttgtagtagtttatgttgctgctgaaacatctggttgcaatgctcctctgcatatcctagccccagggaaatctcagaagaatggtgtgattagaatgtaagggctattcaagggtatgctgaggtggagggtatggcagacacatctggcagcaataacttaacttaagcataccctgagaatgatcctacaatcaaagaagaatgtatgcttggagttctgagctaaggatctgggagtggccaacttggagatccactccttatctatgaaggacatttgaatccccacctcatccattagaacacaggtcatactggggattgaggccctttgttttggattaaatggaggttgttaggtggagggttctaatgaaaatactgtgtgaactgcatgctttttacaaataatagcagttctcctgtccagataccaccactggaccacccttgtatgtaagttccactaataaaccctgcatcatgttagctttctccaggtcccttctctagcctctcagacacattgtcatacttagtggagtcaatgggggtccaggatgacaatgtgtcatctgggcaaaacatttccctaattctcttccagtaccacttctaaccttgctgctgaaaggaaagttcattacttatttttttaaatctgtgtttaatatgtataaatgtaagaggttcaaatgcagcattgttacatggatatattgcatagtggcatgaagtctgggcttctactttaatatatgttttctttcctgtctaaagaccatggtttactgaatccaatgagcataaaactcatagtaggggctacttactgcagactgaggagacctggatctcagacctcatatggtgacctcattgtgtgaccttggtacactctcaggacctcagccgtagagtgagggcataggcctacatattctccgcaatcccttcccggactctacagatgcaacgactaattccaaacaaattacaaatataataattgcaatggatccttgaagagggttttacaatcaaggtagaagttgagtttggattggaaggatgaggagggcattccaggtgaatgatgacacatcaaaaccaaggcaggaaagcccaggtcctagtcaggggagagtgaccacaccagtggccagggatctgcatttcgtgtggtccctgctcatatgaaaaaccacaagcctatctttaagtgagtcatggaaggagctatctgtgaagcagatgactactggtctgcactaggatgatgcaattaacctgctaccatcatgcccatgtgcattaataaggcaagtcactgcttgggtgccggtgatgggagcctttgaagacaaggaataacatgctaattttagcgccaaagggcagagcgattagacactaatttagaaaacacattcttttctctcttatgggttaggaatatttcaaaggaaaattaatcagaagtgaatccaatgtctaaatttagtgaggataaacaatacaagaaaatgagcgaatatttgtggtgtatgtacatgaatatgtatgaggtgaagagtgaccaaaataccattagtcaatgctaaatcttcacttaattggccagaagatgcacaagaaaatgatcatatgttgaagggtcatcagctcccagccagggtatataaagggcccagagggggaggaggacattcacacctgagaacatccagctcctctcaatagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagaccccaatgcccccacagagcaatacactgaagcctaaacatctatctggtgtttttaaaaagttaaaagaaaaatagattttttttcacaaggtgacaatagtgatttttaccatctggatacagcctggtgtaagcagacgtccattaccaccctcacccacattttcaggtgtctacatcagccttagtcattatggatagtaaatcgacctttaagaattcctggggtggactttgcaaacacattctacaacctgatggtttttactgctcaaactgtcaccatcatcttttgcaatgtgttgctcactgttgtcaataaactaatttttcctggcatagcagactgccctgctccctgatttgttcgttagtgcatgtttattagcgtacacagataagcaagattttggaacctgcacaagggaaacaaagctcaacctaagcaaaaccttatccatagaaatctcatctattcagtcattcaggaattgtttatcaagggacctccagttgacaggtgctgcctgattagtgatgaacaagctacatgccttgtatccaagaagcttatggtctaatggaatagacaaaaggaaagacaatgttcatgaagaggggtagaagtgggaatagcatatgccaagcccagaatgaccactggtagtaaactgaccagcacagcgcatctcatcttcttaccacagttcctagagtagcatttttcaaagtgtggcccatgcgtcatacacaatagaatctcttgcaattgcctattaaaatgcacattcttaggccccaaaccaaacctaatgaatcaaaatctctgggagtggggcccaaggctgtttattttctatcacttccatgtaattcattagaatttcaggaccattatttcagaggaagaccaggatttgagctccttgagggcttaacaagcatggcctggaagccttccaagaatagtcacaaggacaagccacaatgaagacacccaaagtgaagaaaaaaatgtaatataataataagtatgaaacagcacctgctaaactgtaatcagaagaatcggtttggcagagaagtgaatgtaaatgaatgtgcaaaaaaacagtatcttgagtttgtcataggtggaataaaatgacaacaaaaaaagagagacaaaaagtaagagataagggatgaataaaaagtgaagaggggaggcaaggcaatgaataggaggaagagtgaagaggaagatgatggagatgatgagaaagacagaagaggaacagagacaggcactaggattcctggtacaagtatttggtatttgaagatgttacaggagagctaggccagtcctcagattacccatgtggctaggaagtgtgtgcacatcaggtggtctgctgcctgtcctttgcccatctctatagatccatgtctcactgctccccactaagattcacttcaagcaacactgaccttatagttattaaacatttgcagttccaaatgtttcgcttttcctcatgttctttcacttatctgttcttttacacactctttctcttcaccttcatcacctacttaactctgattcatttccaagattcaattcagtcttctccagtagtcctgtcccaacccctgtatcacacaaacacatgtgcaaatgcatacacacacacacacacacacacacacacatacaggttaggagctctcagcaagttccaatagcttacctccctccccataaggcattgtattgagattatatgtttttttgcctccaaggaggggaccacagtttgtttttggcttccaatactgagctcaaagtttaatacgtagccggtacttaatttctgtttgtttagttgtcaaaataaaaggaaattgtctttaccacaagaattttaaaaggtagataattatttaaagaaaaaattttggcattagtgtaacttaacctctctgactctcgagttttctcatccgcaaaatgggaaaagcaacatttaccaatgtagattgctagggaagttaaataacaattataactttttatgtatgcaagatgcctggcacatagttaaatgcccagtaacattcatttatattccttgtggagcatttggacatcactgtatcgaacaggctcaaaagatgtgctatctactacatatcaactcactgggaatgggaacaaattcaggggagggctttactaaccaaacttaaattgtaattttttttcaggatagtctacatctaccagtaggaatagattttctaataaatataatgaagaaggcaaaaaaaaaaacccacaacaacttggcatcagattaaggctgtctcagaatgaaaataatctttaaaaattcattctacaagtccacaggaatgagtcctagattataggatttatgaataggagtgcagcatcaggtaaaagaaggattgagcaacatgtaagtatctgatggttcgactctttctttcacattgaaccttccaagggaattaaacaactcaaagctgtaatagacctcaaaagattactttgccttccctgactttaggcaaatgaatatctaaaaaactcagatgaaatttttaaaaaaattctagcaacaaattccaccagtcccctgatcatttagtttttctgtctctcacaactaaactcttttcttttctaattatatctaattaattatatccctttctctgtcttccatgtttgtatggattttatgataagccagcctctgaagaacaccaggcaccgaagactctgcccattttacagatgaggaaacctggctaagggtaagtcatttactctaagttagacaactgcaaagaggtggagaaaggactggaatccttctttatcttctccattttcctcctgccctgtgcccgtcaatattccccatcccatccctgactcttatgattggaggatatttttaagattatttctgagaacgaagtccttaaggaatgtattttctaattttagaattttaataattttcctaacatctagtggcttccagactagttcctaacaaaatataattcataaaactattaagaagagggcatggcccaccatcacaagaggtcaccaacactacattctttatctatccaactacaaaaatctcacaagttattttcactgtgcttcagatttacttgtttccatcctggtgattatgcacttgaagaatgtgtggaacttgaataacatgactaaaaaagtccatgtggtaaagaccagggatacatctcttgtccaatagcttaggactattaatgtgctacagcaagggagaccacatggctgaggaccatggggcatcctcccaaacaaaggaggagaaatgttattataaaatgttgaggaatggtggggtaaaattacgtgacatagtgttttcataggctcaagaaaaacagggctgtgtataaaaaataattaacaccagacctgagctgtgaaacagacttatggtcctctttcactggaaactgtatagttgagacaaatggggaatgttgtgtctgcaagtcacttgtctgaaattctgtacctgggttgggtactgaggttgcttctctgtccagatgacttagatcctgtctaggcaagagtgaaatgtttccttcttactgatgtggcttggaagagcaaggtttctaacagcctataattttagaaaacagtatttcttagtactgtgttcttttgttaacaaaagcagtggatttacagacatatttctctttttagtttggcatctctgtatacattccaaaacaaagaacagaatgctaaaccatgtatcaagtgagtacttattttatttcactaaagggaataaaactttttaataactactgctacatgttatctattttgagtgactccgagttggaaaaagactgggagacatcaccagtgtttctactccacagaagacctgtggtattgctaaatatttgccactctttgatccgtacgactttggaggaattcattttgtaaatctggtcttccaaaaactgtgatggactatgatggatcatagactcaaaggacttcaaagatcagggatatgatagaccaaagggtgtatttttaaaaagagaaaacaaaacaaaacacacctcagaggtaaatttgcactgaagaccatcagcattccttggacaatgttatctttaatctaccttccaactctaaatttattttctgtattcctattcatctttgctatggctggaaaagacaaagctattttattggtcaccagctaaactaattccccttgtctttttcataatgccaccttcccacctcataaacaaacaaaaccctcagccaacaaactaaagaagctgtgacagaaagataattgattcctttgtagatattgtccatagatttttaagtatgtaatacaaagtgcatatgtcaaagcaagaaagcaagaaatagcccaatttcaattttatttctaggtcaataatcagggaagggcattcagaaaggcacagaatgaatgaaatccccatttagtttgaccttattgttcccagaaaagttctttccctttaattgcttgatttatctttgtcttgccttactaaaagttatgattactatgtgataggaaactatttgaaagctatttttctttcctttccccctccacccccaaatagtacagtaccatctacataataagtgtctcataagtgttaatgagttataaaccaactcagattactaaaataaaatcagtctagcagctttggtgatgattttcttataaacaaggttaggcactgtgtcattaaacactgggccattctttccatagcagaatcaatacacatctgctcttatgagccattttggtttttaagaaattcttgcttgatctcaatgccaatcagaaacccagcctgtgactcatgaacattccagtcccatgcttaagtcacggatggcagcgaacaagaggaaagtgtgatggtggctggattcttcaaacttgcaccttctcacatggcatggcctggaaggactagctgatagatgagcaattgttctgatgatatacatgaccaggtattccgttctagggaaaaagtagacaggtagaaaacaaagcattctttagtgatttagggatcgctgcctcagcagttaaatccagagttctcatttcaacgggcagctacaactccaggaaatgacctcatgtcctgggggtcatcagcatccagctaggatatataaagggcccagagtggaacgaggacattcacacctgagaacatccagctcctctcaacagcccaacccacaccagcctcagacaccaccatgaccggctcctgctgcggctccaccttgtcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcctccctgcggccagccgaccccttgcagcaccacctgcaggacctcctcctgctgagaccccacctctcctctcaacgcacgaaacattcccaggtgcacagaagcttgtgcagactcttctaccccttctggatcagatgagagactccacctttgcagcctagctgatcctcaagcacgaattcaacaataacatcctatctatttccccacataattatgcagctaatcctggccctctctgacaatcttgagaaaaattccagctttcatcattcgaattcctggcttgaaaaaaaaaacgagtaaataaaaatcaaagctcctcttgaatagaactctgtcccactgactcatcacccttttttctactgtttcaaggttctcagatgagatttttttcttccaggataatactatttgtatgctgtatttttgcactgtaaaaaaaaataaaattatatttctggggaagcaaacatttctttttatttattgtttattgctcttcaaaagctcatatttagcttacattacagcatgcagaaccagaagaacgaaaggagagattttctaagggccatttttgagctttagaataggaacaactcaggtggaaggtctataattttaatagcatttcaaataaatctgatcatctcatgattcaccttcatatttcgagtcgcaggttttatggtgatgctgacgaaatggtgagactacagtaggtctctgtaaacataaacttgacttatgaataattcacacacatgataagggggaggaagtctaagctaagttatagccctatttgttcaccaatgtaggaaactgtacggtaattgatgtcaaacaagacctgggaatccctagccactgaacatcctatgctggaggaaccactatcccatcttctccatggttcccgtcagcaccaccatggccagttctacttccagtggagtggctgctgctgagaagacagggagaaatgaagccttggttgtaatcatcctagttttgagctccgcatacatcttaaccatttaaacaactgcaatgcggttgaaatgctgataacattaatccatactgcatatatttttgattttgttaaatacttgtatgttggtaaggaaggctaaccactatcattttcctgataaatatctttttagttcctagcatgtgatagaaaagagatttctttgattgttcagcatgtattcctgggcatatctacctgcccattgagagaagtgaggcaagggaagctttgtgagggcaggggtctttagtctttttaatttaaatttatttcaagttcaggggtacatgtgcacgtttgttatataggtaaattgtgtgtcacagggttttggtatacagattatttcatcacccaggtaataagcatagtaacagatggccaggtgcagtggctcaagcctgaaatcccagcactttgggaggctgagatgggtaggtcacttgaggccaggaattcaagaccatcctggccaacatggtgaaaccctgtctctactaaaaatacaaaaagtagctgggcatggtggcatgcgcctgtaatccaagctactcaggaggctgaatcaggagaatcgcttgaacctgggaggcagaggctttggtgagacaaggttgcgccactgcactcctgcctgggtgacagagtgagactctgtctcaaaacttaattaattaattaatttaattaaacaaaagcatagtaacagatagatggtttttttatcctcaccctcttcccaccatctgccctcaagtaagcttcagtatctgttgttcccttatttgtgtccatatgtactcaatgtttagctaccacttataagtgagaacatgccgtatttggttttctgtatctgtgttagtttgcttaggataatggcctccagcttcatccacattgctacaaaggacataatttccttttttatggctgtatagtattccatggtgtatgtgtaccacattttctttatccagtccacccttgatgggtatttaggttgattccatatctttgctactttgaacagtgctgcaataaacatatgcatgtatatgtctttatggtagaatgatttcaatccctctgggtccatacccactaatgggattgctgggttgaatggtaattctgttttaaatactttcagaaattgccaaactgctttccacaatggctgagctaatttacattgagggccaggatctcgactaactttgttcactactagattcccactgatctgcacgatatttggcacattgagtataatcagaaatgatgtgttgaatgataaatgagtaagttctaaggggattggttaaaacagagaaagacattatcattccatcccaactctcaactcatgctggatatgcatattcttaaaataaaacaataaaccaatcatgaagaaagatcttttttctggaaatatggtaaaagtttctcaacaagaagactgttatattcaaaaactttacatttgcagtacgtgcacaatggagttttatcttttttaacggtttggtaattaaccaatggataggctcacaagtctaatttctttctatatattcttgatcactgttttcaaaattcgttaagtacatctgtttttctcctctcagagtttttcttgttagccttctagagacctccttatttaaaagtgttttctcaaatggacaatgccttgtttcccctcaaacctatcattattattggatctcatttattcccacagtcaccccattctctggttggctgaagtggctggtgcagatctgggtaagcctataagaaaccatgcaagtggtgtgatcaataagaatgcttacacttgaaccttcaacttcagatctattaggctggtgcaaaaataattgtagcttctgccattgaaagtgccaaaaaccacaattactttttgcaccaacctaatagaacagtcttagttgtaaaggaaaaggtcagaaccaagtaaattaagaggcaaagactcaaaagtgattgagtgacataatttgcctacaagtcatgacagtttgaaacaattaaaaatgacaattggttccataagcagaaatgagccccagcatagcacacagggagatgttgaagacactgaggtatgggccagatgaggcccgagaacacgttcaagtgggatcactactgaagggttttgttataccgcaagactgcaaccttcctctacatagacttgtttgacttcctcaccatattggtggctttgttcacaataccccataatcattcagttatgcccaactatgacactatctccttagggtatgtttcgacattttcagaaggctgaatagaaggtaattcttcccactcctgaggctgttggtaagacatagagtcctttcaaccgactctaaaaattagacatatcataaataacaactgttttcaaagtaaatacactgtaaaagctcctaaataaaatagacattccttaatacctgggaatgtggtacctacaatccattctttagctacagtgagttcttcagctttttgggctgataaataatgttcccacagatatttctggaatgagtattggctccaacacttactaggtacatgaccttgggtaagtcacttatctggttccttatgtgtgaaatgagaaataaacaatatccacatcctaagaatgttatgaagattagattaatgcatgtattttttaatatgatgcttggaacatagttacaacttaatgatactggctatcatgaagattacagtgaaatttaccttggtctggaaagatacaaccatagaaatcaatgaacatatctctaagacaaaaaccactggatgatggaaacctactaaaatgcattcttgtacctccaaaaaggggacaggaaaattcttcttttactgagaaatcctgacttttaaactatccctgtagtattatcctcaacttgttttgcccaggaagcttagcagtggcaaagaatactaacaacttgagatgctcgctttacttcaactgctagcaagtaataaccctcagagcatgcagagcacaacagctgctttgagctatcaaaacagcaactagcaaaagcgtcattgaattataacgataattggagactttgaagttagggtcattaaattcatatttgaaccataaatagcaaaatataatgggtctacactaaataaggaaaatagacttttatgtgtacctgagcatctaaacaatgtctacaaaacttactaatctgctggtgttatttcaggaagaataagtgaaaacaaggaaatgaccttgtgtcctgggggtcatcagctcccagccagcgtatataaagggcccagagggggaggaggacattcacacctgagaacatccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagcccgttatcacgaagggcccctcagaagatggccaggtccatcccgctgcccctcagggcttcaccgcagagcaatacacgtttccttgagaagcccatttctcatctcttcatactagctcacactatgcattgaagacaccttttcagaccaaccacagatgagaaatacttttcctaggactccagtctaactcctatatcatgttgtctgctttctaataaactcaatactcctaccatagaaatcatggtctttgtgatattttcttctgggagattgtctctttttttctagagatactcaaagcaagatgcagaataatcctcttatacagttctcataacttaagtctgagtagttttcttataatcattgtaaatggcatttatggagcacagctgagtcaggaagatggatacaactatgactttatcatgtgtacagagtcacttgtgcccaaaattccaggcatgcattgaacacctgagaaatgttctgcaacaagaaacacgctaggaggccgcacctgggttgaaacttacattcccagcctaatggtgtgtttactgatccgacacctgttggaacatcatagaacgcccagggtgttagaggtggaagaagccttaggcaacctctggccaattacctctgtttttgaagttaaagaaacatgaataatgtaagagtaaataagttacttactaatgtaattataatcccaaaagttcagaaaagaccctggagaatacaagtttcctgcatttagacctcaggtcaaacacttcttagtatggtgagagacatgttaatcacaaaatggttgtacattctacaactttattttacatttcaatagccacacacacacatatacacacttcctaggaatacatctagccaaggaagtgaaaaatctctacagagaaaactacagaacacgacttaaagaaatgataggtgacacaaacgaatggaaaaacatcccatgccaatggattggaagaatcagtatcattaaaatgaccacactgcccaaagcaatctacagattcaatgctatttctatcaagctaccaatgtcatttttcacagaactagaaaaaaactattctgaaattcataaggaaccaaaaagagcccaaatagccaaagcaatcgtaaataaaaagaaaactgaaggcatcacattacctgacttcaaactatgctataagactacagtaaacaaaacagcatggtactggtacaaaaacagaaagttgtaaaatataaagtggcatagacaaaaggaacagaatagagaacccagaaataaagccatgctcatacaacaatctaatctttgatatcattaacaaaaataagcaatgaggataggactccctattcaataagtggtgctgggatagctggctagctttatgcagatgattgaaactagaccctgactttcaccatatagaaaaattaactcaagatggattaaagatttaaatgtaagacctcaaactttaaaaaccctaggagaaaatctagaaaacataattcttaacatcaaccttgggaaagaatttatgactaagtcctcaaaagcaattgcaacaaacacaaaaattggcaagtgggacctaattaaactaaagagcttctgcacagtaaatgaaactatgaacacagtaaatagacaacctacagaatgagagaaaatattcacaaactgtgcatccaacaaaggcctaacatccagaatctataaggaacttaaacaattgaacaagcaaaaacaaataatcccattaaaaagtgggcaaaggacttgaacaatcacttctcaaaacaagacatacaagcagccaaacacacatgtgaaaaaatgctccacatcattattcatcaaagaaatgcaaaatcaaaaccacaatgagataccatcttacaccagtcaaaatggctattattaaaaagctcagtaactgaagccccatactttcagaataaagaaaaaaatagttaaaaaacaacagatgctgacaaggctgttgagaggagagaatgcttatatgctgttgatgggaatgtaaattagttcagctactatggaaagcagtgtggagatttctcaggaacttaaagtagaactatcatttgacccagcaatccctttacttggtctgtagccaaaagaaaacaaatcattctaccaaaaagacacatgcacttgcatgtttgtcacagtacaattcacaatagcaaagacatggaatcgacctaggttcccatcagtggtggactggatagagaaaatatggtacacatacaccatggaatactactcacccataaaaaacaatgaactcatgtccttcacagtaacatggatgcagctgggggccattatcctaaacaaattaacccaggaacagaaaaccaaatgccatattttctcactgacaaatgggagttaaacatcgggtactcattgacataatgatggcaacaatagacactggggactactagagcaggcagagcgggagggagacaagggctgaaaaactgttgggtgctacactcagtcctgggtgacaggatcgatcataccccaaacctcagcatcacacagtatacccacataacaaactggcacatcacacaatataccacctgaatctaaaggaaaagttgaaataatgaaaaaaaaatttgttcataatgttattgttaaatgataatgtgaaataaagctctggagtttgttacacaaaatctgttgtccatcaccatgagaaatctgtctaaatcaatttgaaggcttttttttttaaggatgcttctctaagaccccattctgtattgcatgggctgtggggttctcagtaggggtcttgttgctatacacagtcctgacagatatgccttctgtcagttcaacaatagcctgactcccttcacagaggtaagtgctcaatgagaaggtgctctgtttcttccttccaggtgcttttattttatttcatgctattaatggaacttactactgaataatgttatttcatgtgtattgtttggtgactgagcagagaactaaccatttgccataacaaatatgttggtcttttttctaaacttaaagtttagaatttagaaagtaccaatgtaacatgaccttttgctatatatacatatggtatacatatagtaaatatatatagtatatgtaaaatacatatagtaaaatatatatacatatttgtatatatacatatatactatatatagtaaaatatatctagtatatctgtatatataaatatataatatattatattatatattttactatatataatatattatatatattttactatatataatatattatatatttactatatataatatattatatatattttactatacataatatattatatatttactatatataatatattatatatattttactatatataatatattatatattttactatatataatatattatatattttactatatatataatatattatatatattttaatatatatataatatattatatatattttactatatataatatattatatattttactatatataatatattatatatattttactatatataatatattatatatattttactatatataatatattatatatattttactatatataatatattatatatattttactatatatataatatattatatatattttactatatataatatgttatatatattttactatatatataatatattatatatattttactatatataatatattatatatattttactatatatattatattatatatattttactatatatataatatattatatatattttactatatatgtaatatattatatatattttactatatatgtaatatatatgtaccatattatcggggaacctgccccgataatcacgtatgttcttttctattttcctaagcatcggctggcttgagaaataaagggacagagaacaaaagagagaaactttaaagctgggtgtccgggggagacatcacattttggtaggatccgtgatgccccacaagccacaaaaaccagcaagtttttattagggagtttcaaaaggggagagagtatacgaataggtgtgagtgacagacatcaagtacttaacagggtaatgcaatatcacaaggcaagtggaggcagggcgagatcagaggaccacaggaccgaggtgaaattaaaattgctaatgaagttttgggcaccactgtcattgataacatcttatcaggagacagggttttgagatcaaccggtctgaccaaaagttattaggtgggaatttcctcttcctaataagcctgggagcgctatgggagactggagtttatttcacctctgcaatctcgaccataagagacaggtacaccccgggggggccagttcagagacctacccctaggtgcgcattctctttctcagggacgttccacgctgagaaaaagaattcagcgatgtttctcccatttgcttttgaaagaagagaaatatggctctgttctgcccggctcaccagcggtcagagtttaagattatctctcttattccctgaacaattgctgttattctgttcttttttcagggtgcccacatttcatattgctcaaacagacatgctgtacaatttttgtagttaatgcaattattacagggtcctggaatgatatacatcctcctcaactgacaggattaagagattaaagtaaagacaggcataggaaatcacaagggtattgattggggaagtgataagtgtccatgaaatctttacaatttatgtttagagatttcagtaaagacaggcataagaaattacaaaagtattaatttgaggaactaataaatgtccataaaatcttcacaatccacgttcttctgtcatggcttcagtcagtccctccgtttggggttcctgacttcccgcaacaccatatacatatatagtatacatacatatatactgtatacatatatactatacatattttactatatatgtaatacatatgtatatatacatatatactatatatattttactatatatatagtaaaaggtcatgttactatatatgtgtatatatgtgtgtatatatatatttactatatatatatatatttaacaaatacaagacactaagtgccagacattgtttgttcttagcacttgacaaatattagctcatgtaatccttacaattctgatatgaactattattatggcccaaggacacacagccagtaagtggcagagctttaaatgagcattgtccagtttcagaataagtggggtcagaaaataggatgtgacttgccaccaagtgtcaaaccgcagagctgtctgtgctcttacaactctgaggcatgaataactgaagcatgacccatattttctctgcctgaaaacgaagtttggctatggggtgtggataagtgtcttagagtgaataaacactagaaaggttactgagtgatgcacagattatctttttggacctttataaaggggagacagatccttataaaggggagagacagatctttataaaggggagagacagatctctttagaatgaccttgggtttgaagtttctgcagtagagaaatgagtcttgttaatgtgatgatttaagtcttccaaagaggctcccattgcataaaatgtgattatcatgaagactccacagcagcatgaaaataaattatgagataatatgtctcgaaaagagcagaatatacaactttttacctagttacctctggttaccactttgaaaaacaaaaatcccacgtccgtaaacaaagaaaagaatgtaaaacaggagagtcaaaggtctctagcgatgagattgtgcctgatatctccctcttctgtttccctaattgtgactaccgggtccagtcaatttacattcctcttaaagttttgaaattatgcttgaaattccatttggggagctttagatgtccggccccaaggcacattctttcaaataaagaaaatgatcccgaagtgattcaaaaccctgtctggtgactaacaggaggagtaaagctggaaagtaatgggactgtttcccccatgtagttcctgaactgcccctggcaacacttcctgaagaagcgcatccatcacgcttttagcagtgccacagcagaacactgggcagcctcccaatgcgtctacccctgaacagtgttctggatatgtgtgcaatgttggttgaaaacccctttcttgtcacttgctaatcagagcacctatgtcaaagtatatatgcatatttcttttttgagatggagtctcactctgtagcccaagctggagtgcaatggcatgatctcggctcactgcaacctccgcctttggggctcaagtgattctcgttccccagcctccggcacagctgggactacaggcactgccaccacacccagctaattttttgtattttattagagttgaggtttcaccatgttgcccagggtggtcttgaactcctgagctcaggtgatccacctgccttggcctccccaggtgttgggattacaggcatgagccactgcgcccggccaacaaggtatattcagaaaaatttcccattacagaattcttcattacatgcacaagaaaggcaacgctaaaaaatgacatgtttcagagataaaaatcagcatcttatgacagaaagaccagagttgcacagaacctgaactagagaaaagaaaacatgcaaggcagtcttggaggttttattccaacacttagtggtttgcaaaaatttttgtctgtcctgtacaactctatgagctgctatcctattcaaggcctatgtatcccactatatcaagtgataatcaaacgtattcccaagcagactacgtgggagggcttgtctaacactcgtgtgattcacgtttcacatgtaggtgcttccaaggacttgagtcccctattggggtcaggataggctctactcaatgttctatgtacttctctatgtttttaatttcttttaaaaactgaagtttttttagaccgttttgtccagatttgatccagtgttatctactcaaaataagcatcaagagctactatcacctcaaatgacgatgagttcttagattttcacccaatgtgagtacatccatacttagagataaaacaagagctctttagtgagataatgagtgtgtcacaagcaaccattagtcaaaacaaaattctacttaattggccaaaaggtaaacgaaaagggtcacctgcacccggccagggtatataaagggcccagagggggaggaggacattcacacctgagaacatccagctcctctccacagcccaacccacaccagcctcagacaccaccatgaccggctcctgctgcggctccaccttctcctccctgagctacgggggaggctgctgccagccctgctgctgccgcgacccctgctgctgccgccccgtgacctgccagaccaccgtgtgccgccccgtgacctgcgtgccccgctgcacgcgccccatctgcgagccctgccgccgcccggtgtgctgcgacccctgctccctgcaggaaggctgctgccgccccatcacctgctgcccctcgtcgtgcacggctgtggtgtgcaggccctgctgctgggccaccacctgctgccagcctgtgtctgtgcagtccccctgctgccggcccccctgcggccagccgaccccttgcagcaccacctgcaggacctcctcctgctgagccaccacctgctgccagcctgtgtctgtgcagtccccctgcggccagccgaccccttgcagcaccacctgcaggacctcctcctgctgagcagtgcactgactgcccggaacgcgtaactcaccttctgaaaaagtcacactcccatttctctactttaacaaacctcctgccctgagcccacaaaaccccacatcaaccaagcagggaaccgagcactgggctcatctattaagacctgggccattctgaagtctgtaaaagaagcaatttccttcttcttaagatttcgtggcatgtttattttctaataaatatctgttctttggccttgcaaaaagatttggttttatttactcattctaatattttgtattaaattaattttttaattaaaaaaactgacacataattgtacatatttatggggtgcaatgtaatgtttccatacatgtatacgttgtgtaataatcaagtcagggtgtttagcatattcgtcacctcatacatttatcatttcttcatggtaagatcatttaaaatattctctgatcgctattttgaaatatatgataaaatattactaaccacagtcaccctactgtacattagaataccaaaacttatccctcctatctacctgtaactttgtacctgtagaccaatctctgcctatcctcccctcctctcaccctccccagcctctggtagtcactattctactctctacttctatgagatcaacttctttagatttcacataggagtgagtgaatgtgctatttgtctttctgtgcctggttaatttcacttaacataatgtcccccaggttcatccatgttgctgcacatgacagtatttcattctttttcatggctgatagtatttcattgtgtgtttgggtgtgagtgtgtgtcacattttctttatccattcatccattgatgaacacttagattgttttcatatgttggctgttgtgaatcgtgctgcaataaacatggaagtgcagaaatctcctcaacatactgatttcatttcctttgcgtatatactcagtagtgggattcctggatcacatgatcgtcctatttttaatttttggggaaccctccatactgttttccataatggctatactactttacattccctctaaccttgtatgagttcccttttttccacatccacaccagcatttgttatctttttgtatttttgataatagccattctaattgtggtgatatggtatctcattgcggttttgatttgcatttcctgatgattagtgatgctgagcacttcttcatatatgtgttggaaatttgtatgttttcttttgtgaaatatctattcaggtcttttacctatttttaattggattttttattattattcactgttgagttgttcaagttccttatatattctagatattaacccctggtcagatgcatagtttgaaaatattttctcccaaatttttgcaatctactcatctgacaaagggctaatatccagaatctacaaagaactcaaacaaatttacaagaaaaaaacaaacaaccccatcaataagtgggtgaaggatatgaacagacacttctcaaaagaagacatttatgcagccaacagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttacactgttggtgggactgtaaactagttcaaccattgtggaagacagtgtggcgattcctcagggatctagaactagaaataccatttgacccagccatcccattactgggtatatacccaaaggattataaatcatgctgctataaagatacatgcacatgtatgtttattgcagcactattcacaatagcaaagacttggaaccaacccaaatgtccatcaatgatagattggattaagaaaatgtggcacatatacatggaatactatgcagccataaaaaatgatgagttcatgtcctttgtagggacatggatgaagctggaaaccatcattctcagcaaactatcacaaggacagaaaaccaaacaccgcatgttctcactcataggtgggaattgaacaatgagaacacttggacacaggagggggaacatcacacaccggggactgttgtgtggtggggggaggggggagggatagcattaggagatatacctaatgtaaatgatgagttaatgggtgcagcacaccaacatggcacacgtatacatatgtaacaaacctgcacgttgtgcacatgtaccctagaacttaaaagtataataaaaaaaaaagtaccaaaaaagaaaatattttctcccattctctaggctgtctcttcactctgctgatttgattgtttcctttgctgtgcagaaggttttaattttatataatcccatttgtttactttcacttttgttgcctgtgcctttgaggtcttatccccccaagaaaaaaccattgcccagacaagtgtcataaaatgtttcctgtgggttttcttctagttgttttattatatgtggtcttatatttaagtatttaatccattttgggttgtttttaaatgagttaagaaatagggtctaaatgtgctgcttgcctaccatatgcaagtcacaggctatatggtataaaatagaaagtaaaattgaattaaaaatgttcccatcttcaaaaagattctagagacatgagtcatattcacctataattcatctaaaaactagaatattaaaaaataaaagtacaacactgtgtggtgtcaacacagaagtcactgttggttggggaaaataagaaagattgaaaagagaagctaacattttatataggttcagattgtggtgtccagatcacagggatggcattctcagcaatagaaatagtatgagcaaaggtgtggagggaggggaaccatagggttgttcagagtacggtttggctgggggcactggatatatatagagtgataatgaaagaaagatttggaaaatttgtatgctttgaatactagccaacggagtacacccttaatgcaataagcagtaaggagttgttgaaagctttggggcaggaaaatggcataacaagagcagggcattgggacaattctcatgatagctccttataaagacagaggtcaaaggccagagaaatgagtcgtacagaactatacagaaactaatcaggaagatattgccttggtcaagtgattacaataagagctcaactaagataatacccatggaataaagaagacacaatgagtatagcagatgtagaaacccagaaagtatattaacttagttgaatgtgggaaacaaaaaacaactaggaggcaaatgtgacttattccaattataagtctctggtccagatacttaaaagaactttaacatatttgtacttatttattgtgtatttaaaatcactactccatagtgccatctctctaccatctaatatttctattcttgtgctattacaaaataccttttttttttagaaaaaaagacaaagacaaagagccttactaacattaattgattctgaaaagcagcatggtataaaataaaaagaactggtctaggaacaagtgataggaattttatacccagctcttctggttgtgtactgtgtgaatggaacaagccacttaacctcttcaagactcaagagtattctaacatcagccgatgttaagtgaaaatgaaaagtgctccatagcacatcaccaatgttcccatttagaactttgagactaaatggttctatactcaactcttttccttgattaatccctcctattgctactacactgatttttatactagagcaagatacaaaacaaatagatgggatcttgctttctgtataagcctttagtgctctgggcatagtagaagttaataaatatgtgctatttataataagaatgatgtcagtttctacacctataaaattaagtggtggaacaagataatttactacatttttgatctccaacattcattgattacatataaccattttcaacttcatacctacagtcatggttaccatatgacgtgaacatctttactgaagctggcatgaatcacattgtgatataaccccattcctgtacaaacaaatgccaccacctcataaaaagctaactatgtgtttctattcatgattggaagggagaaataaacctaccccaagtagaaataatatgtttttgaccagccttttttcatttatctcacgtaaccctaaactcccagtgaaaattacattctttcttctggcaatgaccaggaattgttttaacttttattttgctgaaatttttcttaatctctttgcatttattatactacacctcttgaactatatttggtcacccattttctaacctgccttataaagcagataaaagtattttctaactcttgctttttctttgatttattccctttcctaaattcagttgtcatgctctttggtctaatatcttttcacaggacacatggtttagtaacttgaaatgacataaattaaaattaaattctgcctttgaaaaattatatgccagataatccatatacaagtgatttttgtctttcatagagaagtgtaaattttgttaaaatattttgcaattttttccaattactgaatatgaattttagcctcttttttaagagacattgaaattgaacaggttttgttttatatatcctcctgagtgatcaatgtttcctaaaatatgaatgtgaagttcaggagatatcacagaaattggaaagattccatttcagggaaaaatctatgaatttctatgaatatagagtttatcagagtttctatctggctaataagattatatcgagagaggataatcttattagtctaaaaaatacaaagcagtcttacataagggcaatcatgattaataattcttttctggagacctgaggtttggtgaatatgatctccaaaatcacatcaccttatgggtgagagtcactttgtcaggtgatatacccacaagtgcaaacctgaagctgaagctcaagtggaaattataccattgtttgtaaacaaaatgttaacatttttaccaaggacaaacacatttggtgagtattagctgagcaataaggaaaaatcaattttgagatatatttaaaacaattcagcatttgaaccatcagagggccctagaaaggctggtttaaagagtaacaagataaaaatgttgctcgccacaaatagaggaattggcccagacttataaaaagccggcagtggaataggcagccataattcagaaactcctccaagcaacccaaccttcagatcaactcctgacaccatggcctgctgtcagaccagcttctgtggatttcccagctgctccaccagtgggacctgcggctccagctgctgccagccaagctgctgtgagaccagctcctgccagccacgctgctgtgagaccagctgctgccagccaagctgctgccagaccagcttctgtggatttcctagcttctcaaccggtgggacttgtgactctagctgctgccagccaagctgctgtgaaactagctgctgccagccaagctgctaccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgcgtggtgagctgcacacccccatcctgctgccagctgcaccacgccgaggcctcctgctgccgcccatcctactgtggacagtcctgttgccgcccagtctgctgctgctactgctctgagcccacttgttgaaaacctccttctgctggggatcctgataagatggcaccttaaaactagccaaattagaatcctaacaatcttctgaactccagtacctataactgggcttgcaacctctcatcacacagccacataaattccctaggaagtaaattcatttacaatggaagaccaaaaatttttcctagacctggttgtcagccaaagtcctacaatgtgaaaagagttagatactattttactataaatatcacctgaaatatttcaacagttattgggacttaaatttaataaaagttttcatctcttcaatgatgaagttgttgtttgaactttctttgctttggaatttattaacaatattggggtactgggatttttcaaaatatcaacatgacatgacactatggtttttctgtacttttgctcttttaatgatgatatttaacagcaattttcctttgttttaccattaaatggtccaatattttgcagccaagacatatgattaaaggaacttgacaacatttaggaactgtttcctaaggtcctctcatgtgcaaagtggtgggctaggtattccaacagattgattcagcttcttgaggttttgccaaatctattcattcatccattcatatatgaggttgtatacaattatttctgtcctccaagatatacaaaagcataataaaaattgtgaaagaatacaaacacaagattacagagtaatagcatgtaacgaatatacacatttcattcaaggtctaggctcataactcccatagcccttttattgatgttagggcactttacacttcagaagcaggcctcagaaaacagaatctctctctctctcgctctcgctcactcacttgctcttgctctctctctctctctggccttctccccacctcttttcacctgctccttttactcctcaaggcaagaatcttcccccactgttcttggcactggccatcaagatattctcctacctaccttgcctgattgtaggtcataagatccccatttcagaagaggttctgccccatgccctggaggaaggaaggctgcatagagagaccaagaaggatctgacagacaggtttcatcactcactctactaacattagatcatactctttttgtccaatcacgtttctaatggttgtccatcatgcccatccactgaagtccccgtaaaatgttcaaaaaaaaaaaaaaaaaaaaacccacagagtttgaggagcttccagatagctgaatgtgtggaggttcctggaatgtgctgttcccagagaggttatgaaagctcctcataccccttcccccacacctcaccctatgcatctcttcttctgtgccatttgtaattgtctttataataaaccaataagctaaatgtttccctgagtcctgggacctgccctagcacattcatcaaacttgagggtgtcatggaattcccaatttatggctggttggtcagaagcacaggcaaaacaacctggagcttgtgcttggcactggaagtagggggcagtcttacagaactgagccctccccctgtaaaacctgacactatcaccaagtaaatagcgttagaatggaattggagtggaaaacatgcagctggtatctgctgcagaatttatttccttgcttcttgatggggagaaatccccacacattagccacagaaatcttctgtgttgattgttgttgagtgagagagtagaaagaacatttgagtgtgtttttttttccttctacccaatagcataagatgtaaaaatagcttatgctattgggtagaagaacaaaaagctaaatcaagactcctgagttctagtcccaactttgtaactagctatccatgaatccttgagcaagtcccttcacttgcctgggtacctatttctaatttgggaaatgagagaattgagtcattactgacaacatcccttccaggcataagagggtagataatttcctaaacaggctacacactgaccagtaatagcttcagatgcccaaagaggaaaaaatatacagtggtcaaattatgttgtatgctttatcacctttttgcaagtttataaagccacactggaatattaaagggactgagatggcctgcaataaataaagctctacaaccagtggccgggctcagtggctcacacctgtcatcctagcacttccggaggctgaggcaggtggatcacctgaggtcacaagttcgagaccagcatgacaaacatggcaaaaccccgtgtctactaaaaatacaaaaattagccaggcgtcatggcgggcacctgtggtcttacaggctgaagcaggagaatcacttgaatccaggaggtggaggttgcggtgaaacaagatcgcgccactacactacagcctgggtgacagagtgagagtccatctcaaaaaaaaaaaaaaagaaaaagaaaagaaaaaaaaaacaactctataaccatcactcccaaactaacttagccagaaaactctctatttttatgttacctgttaacaccctgtaacacaaatactcctcaaaatatactttgaaaaatgatgaaagggagtatcaactgatgtttttataatacctgtataatcttcttatgtattgtgaagcagaaaataaatgttcactgcaaggatggatttaaatactgtcactgttcttattctaattttcagagagagttctagatgaagcaagcattaaataaaagacgcatagtgaggctttcattccaagggataaaatcttttgtcattaaatcaaagtggtgagccagtgcctgggggtagaggggtatgggaagtgattgcttaaaggtcatgggggtgttcttctgcgatgatggaaaagtttttgaagctagagagagatgatgttgcccaatattataaatatactatatgtcactcaattatacactttaaaatggttaattgtaggttatgtgaatttaacctccattttaaaaaatcaaaagaacaggacctctgctagcacaactttaaaagaattaggaaaaggcaccactttggagaagatacagacagaggagtgcacagtttgttgagcctccagcttgatgtaagaaataatatgctccttcctctgagtggacagagccacacatcagggcgcgacctgtacatctatacacaatggccctacaatgtagtcaacattttattcccctcatttagagctctgttgtctctgagagggtttaggttggatgtaccttttaattaaaaggactttggctcagaagcaccccaaaaaatcctggttggcattcaggagggaagagatagatcttgtgacttggcttaggataaaagttggtagtaagaggaggtccttgaagtttatgtgttatctggtctagattactaggatggaagcccagagcagaagcacagaagccctacataggaatgttgtattcatttgactggtacatcaatcatgttttatttctcgagaatctaagtaaggcagtcacaaccgaattagagaactagtaaaacggagatgaagaaattgggagaatccccagaacttgtaactagaaaaccagaaccatgatatcttaaagaaaaataatttcaaacattagtgtctgtgttaaaccaaagccacgttcaggaataacagacaaacacattctttcttcttatggtactggaatggtctacagcccatcacttaaatgaagtaatgaatgccagagggaatcagcacagtaataagaaatgtggtatatacacacaacggaatactattgagtctataaaaagcaggaaattcggtcacatattacaacatacctaaacttgaaggatataatgtaaagtgaaataaaataaatttcattttcttaatttacttagaggaggtaagggaatgttcagattagtcttcgttctgtggcacaggagtcaaattctcaagtaagtgtcataccttaaattttgcattgaggaagatgttgaaaatagtgccacagtagaaaagcccagaaagggagaactgatatgcaacgccactgtctccagtgctcttatcaataatgtatttcaggtcctcagatatctgagccttttgcaaaaggagatacatctgtttagtatcaaagattctgctaaatttagatctgaattaaatagctcccgagattgttgtcatgacacacccacgtatttcaagcatccaacataaaaaatattagctaatcaaagaatctgtgatgtagctttgcttaagaagaagcaaggaattcacaaagaatcatatcttttaaaccaaatttgatgtgggatttgaaaatatgtcttaattctgactcagaaagagttatgatgtaaactcaaagctgtcatttctagagaagcagaactaccacttggtgttctggttcaaaatccaagagtagcatcgtaacttgcatttctcagtaatgaacccatactccatggaggcctggtcaccttttattgcatctaaacaaaacctttatattcaccgtcatcagctgtctcattcaaattatataaactttccagttcactggattagtctctaatatctataataaactgcatacagccgatctaacactctgtagtaaatcacatactccagtattaatatgttaaaaactataattttatgcagttaaaaaatctaaatctatagaatatcctaagataaaagatgagacaaagtcacaagaaggttaacttttttagcacttaagattttcttgaactgtgcttattatgctgttaataaataaataaaatctctaggaatggctgtagtaaactgtgttattacttaccctaagctctcccttccttccttttactctcaaaaaagtccgtaagaaaggaagcaaatttttacggcttgctttcaccattggaatttccttagaatgactttttacataaaaaaagaagaaaggaaagaaagaaaggagaaagaagaaaaagaaagaaagaaagaaagaaagaaagaaagaaagaaagaaagaaaggaaggaaggaaggaaggaaggaaggaaggaaggaaggaaagaaagaaagaaaggaaagaaagaaagaaagaaggaaagaaagaaagaaagaaagaaagaaagaaagaaagaaagaaagaagaaaggagggaaggaaggaaggaagggagaaagacagagagaaagagagaaagaattgactatagtgtttaaagagtttagtctggaatcagaggttgtggattcaaatttcagattcactagatactagtgtgaactagggtaagttacttcaacctgttgtggctcagttttctcacatggttgatgggagtggcagtgatacctagcccatagattgccgtgaaaattcagcaaattgatacatgcgaagtactcagaactatttaggcacataatcagtgatgggaaaatgttatcaatagcaattaatgcaaatctcccaggcccaagaaagcatccctttctggccagctgaatatagtcttgcttcacagtcaaagggaagataagaaagttagagaaggagccacagttaaaattggagggaattaaactgtcatgtgagacccaatcacccagttgtaagggtcaacactgagtaatattgacaatccttaaaggtgaggcatcagtcaattattccttgaccatgaggaaattttaagaaacatgaggagttagggatcatattcctaattaatgccaatgacttcttgaccatggtaaagaagcctaattgcagaccaaatacaatcaactttcaaaggctctcagtaggttcaacaaataattcagggagaggccaattatcattcagagacaaattatccaacacaaataagcaagagacttctggaattatgtaaacagtagctggcccaggcttataaaaggcccaatgtggcagccatcaccaaaactcagaaactcctccaagcaacccagacttcataccagctcccaacaccatgacctgctgccagaccagcttctgtggatatcccagctgctccaccagtgggacatgcggctccagctgctgccagccaagctgctgtgagaccagctgctgccagccaagctgctgccagaccagcttctgcggatttcctagcttctcaactagtgggacctgcagctccagttgctgccagccaagctgctgtgagaccagctgctgccagccaagctgctgccagaccagctcctgcggaactggctgtggcattggtggtggcattggctatggccaggagggcagcagtggagctgtgagcacccgtatcaggtggtgccgcccagactgccgtgtggagggtacctgcctgcccccctgctgtgtggtgagctgcacacccccaacctgctgccagctgcaccacgccgaggcctcctgctgccgcccatcctactgtggacagtcctgctgccgcccagtctgctgctgctactcctgtgagcccacctgctaaaagccagtttgctgattttcaacttgaaatttccactttcagttccattcatgaacgaattatttcttcaagcacttatggacaacgaacaaattcttcaacctttctttgtctttcttatgggggttaccaaatattttggcctcagaattatctgattcctttcaattccagaaagaccttactcttctctctgaggacgccaaaatacaaatttgacccaagaaatgaaaaagccgatttaccttgaaactgagcctttgcaagcattgaagcccacgctctgagtctcagcgccgacgagaccatggaagagccatctgtccttctcaggacactcacttcctgtatcccaccgtcctgcaaattgcaccccctatgaaagaggaataatataccaaggtctaataaattttaactattggtgcaacaaacatatcttttttttttcattgagtgtactcaggatgtatatttcatagaatgtcatatgaaaaactttaatctgcttttgatatcccttctcttctaataccacattaggaaatttgttatccagaggtccagtggaggttaatgaccataaaaacatagagtaagtgtagttatttagggcctcagaaatggcaaaggctctgttaccataacttaaccttacacagtgctttcacaaccaggaagttacagaaatcaaaatctctggctgggtacggtggctcacacctgtaatcccagcattttgggaggccaaggtagacagatcacgaggtcgggagtttgagatcagcttggccaacatggtgaaaccccatctctactaaaaaaaataaattgcatttctatatactaaccatgaaaaatctgtaaggaaaattttaaaaacaattccatcaaaagaataaaatacttatggccgggcatggtggctcatgcctgtaatcccagcactttggtaagctgaggtgggcagatcacctgaggttaggagctcaagtccagcctggccaatatagtgaaaccctgtctctactaaaaatacaaaaattagccaggcatgttcgtggatgcctgtggtcccagctactggggaggctgaggcatgagaattgcttgaacccaggaggtggaggttacagtgagccaagattgtgccacttcactccagcctgggtgacagagtgagactccatttcaaataataataataataataaaataaagaataaaatacttaggaacaaacttagccttggaggggaaagactcgtacaccagaaactacaaaatgttactgaaagaaattaaagaagacacaaataaatgaaaagacatcctgagatcatggattataggatttaatattgttaagatgtcaatactacccagagaatctacagatttaacgcaatccctataaaaatcccaatgatgtttttgcagaaattttaaaaaaatccatcctaaaatacatatgaaattagaaggggtcctatatagccaaaacaatcttaaaaaagaacaaagttggtctcacattttcctgtttcaaaatttactgtaaagctacagtaatcataacagtgtgatactgatataaagacagatatataaagcaatggaaaagaacagagagcctagaaataaaccctcaaatacacatatggttaaatgagttcatttatttatttatttgaattgacaaaaattatatgtatttattgtgtacaacacatttttttggaatatgtatacttcgtacaatggctaaatcaaactaattaacatatgcattacctcacataagtttttttgtagtgaaaacacaaaatctactctcttagcaattttcaggactgtaacatattgttatgaactatagtctctatgttgtacaatagatctcttgaatttattcctcttatctaactgaaattttgtaatcctttgaccaacatcttcccaacacactccaccaccaccctacccccggtaaccaccattctactttctacttccatgaattcaactttttcttttttttgaggtttttttgtttttattatactttaagttctagggtacatgtgcacaacttgcaggtttgttgcatatgtatacatgtgccatgttggtgtgctgcacccaataacttgtcatttacattaagttccacttgtaagtgagaaagtgcaatattagtctttttctttgtctgacttatttcacttagtataatgttctcaagtttaatctgttgccccaaatagcaggatttccttcttttatgaccaataatattccagtgtgtgagtgtgtgtgtgtgtatgtgtgtgtgtatcacattttctttatccactcatttaatgatggacatggacacttaggttgcttccatatcttggctattgtgagtaatgctgcaatgaacatgggaatgcagatgtctcttcaaaatactgatttactttccttcgggtatatacacagaagtgggattgcttgattatatgacagttctatttttaattttctgatgaaccttcatattgttttccataatggctgtactaatttacatttccaccaacagtgtgccagagttctcttttctccacttcctctccaacacttgctatcttttgtctttttgataataactatctaatatgtgtgagacgatatctcattgtggtttcaatttgcattatccgatgattggtgattttgaaaatttttcatatacctgttggcaatttgtagattttttttgagaaatgtctatttagattttttgcccatttttcaattacgttatttgttttcttactacaggtattgagttgtttgagtttcctctatactttggatattaaccctttatcagatatgtggtttataaatattttctcccattcagcggtttgcgtcttcactcagtttagtgttttattggctgtgcagaagctttttagtttgatgtaatcccacttgtctatttttgctgatgcttttggattcatgttcacaatatcacaatattggccaggcaaaagtcatggagtttcctctgttttcttcttatagttttatcattttgagtctttcttacatttcagtcttttaatccattctaagttggtttttgtatataatgtgagacaatggtctaatttcatttcttctgaatgtgaatgtggtcaaatgattttcaacaagggtgacaagactatttacaaatggttaagatggttaatgtaaatggttcataaattttatggtatgtatattttaccacaattaaaaatttgtaactataaacatgtgtaggagacccaaacttttctgaaatagaagatatatatgtatatatgctggtttatatttgcagaagcaaggataaaggtgtcaaagaatgtgcaccaaattcttaatattgattacctctagagcattagttttggaagagatgtgtgcatcttccaggaagggaaaagacactaatttttctttatatacctctgtactctttgacttgttacaatgtgtactcattactagcacatatgtttaatttaatagagtcagaaaacaatctacaagcaaaagtcattaaagattttagttagcaatttgtacattcactattactgaaggcaagaatattagatagagctctgaggatcctataacttgcacaaattgatcatagaaaggcatacttggtttgaaagttgatacatcaggttgtagttcatgttttgatgacactaatgttagtctttccaagtctggacaaattgtttataaaatcatgatcatagttaagtgaccatttaaggaaaaatgatcagttaagataaattctgcctaaaggttatcaaaggacaactatgacaaaacgtgccagggcgacacttggctcaaggctagtctgtcatgtgacttgcataaagaggcacttcggtgcttggcttccatgatgagccttcacttcgcccagagggcaaagaagaaacataatgagacttaattgtacaatggaaaaaggctattgaaatgctatttataactttataaacacctcaggtattagccagagactcacactgaaattgacatcaagaaaaggtgttgggtaaatatgcagctctagggaacatatcaaaggacagatatagaaggtacagcccaaactcagaaacctctcttaacacagctctcaacccaactcctgacaccatggccagctgttccaccagtgggacctgtggctccagctgctgccagccaagctgctgtgaaactagctgctgccagccaagctgctgccagaccagctcctgcggaaccggctgtggcattggtggtggcattggctatggccaggagggcagcggtggatctgtgagcacccgtatcaggtggtgccacccagattgccacgtggagggcacctgcctgcccccctgctacctggtaagctgcacacccccatcctgctgccagctgcaccacgccgaggcctcctgctgccgcccgtcctactgtggacagtcctgctgccgcccagcctgctgctgccactgctgtgagcccacctgctaaaagccaggttgctgatcgcttaagaatgaaaggggaagcacagcaaaattgtgctgatttctgaagaactgttcgattttacttggatgctaagtaccatgatgttgttaagctgctcagagataatgaaactcctagttaggacactgtggatgtgccgaattcacttactgaaagatgtatcaatcagtgttctggatagcttgcgttgcttgagcagaggaccaggatggaatagttcatcatttcagtgacatctctgctcccccaactctctcttgatgctcatgcatcttcagacctggtttttccttgaatatctctgattaatccaaataaaatgttttaatgtgcaaagcaaactgagttatgtcctccttctacctttaaacatgtcttcttgtagctggtattcaagagtggatttgcaatttgataataataccaaggcataaccataaagtctaaaccagaaagattaaatacaaagtaaattatgcttgaatccatcagcttaaaaatgctccatgaattaaagaatttttatagttcaaatatttacatgctctaatctattatgattaggtctagaccaataaaggttgacctttagctaaaatgttaaggttgatcaaagctattgatttctatctaaatgtaattctaccatcttttgtctccttccatttaatatactaaatgttctccttcatttatgccccaaaatctaaagaaattgcattaccttctaaatagatttaaaaatagctactagatactacctattttccaagagaatttaggtttaatttctacaccttagcctttcacattcttcccactgatccttgaattgctctctaagcttcaactcccactattcaccttcatttgatgtacgtatgcataaggtgtatctttggtctaaatgatagtagaagaaacagctatagagagcacccgctgagttctaccattgccatttgtcagacagaagtgttagaaatctgaaacagctcgattatattttgcactttgcaacccaacttaaaagatattctcttaagaagttaacacgctggacacggtggcttacgcctgtaatcccagcactttgggaggctgagatgggtggatcacgaggtcaggagattgagaccatcctgactaatatggtgaaacccagtctttactaaaaatacaaaaaaaaaattagtcaggtgtggtcgtgggtgcctgcagtcccagctacttgggaggctgaggcaggagtatggcgtgaacctgggaggcagagcttgcagtgagccaagatcacgccactgcactccagcctgggcaacaagcaagactctgtctcaaaaaaaaaaattaacacaacctagaacaaaacaaaacatattttaccatttaatttttaaattcttcattaggcattagagtgtaatacacaaaatacaataggatgcaaatatagaaagaaacacgttttccacattatttacaagctcccagaacttacctctatatttaattggtagcaatgatggattacacacaaaattatgcaatttccaagaggaataaagtagatggcagtacatttttcaaagtgtcataactcctagatattttttcccgagcccggttccactactaaatccaaaaaataaaataaaataaaccaaaaaacacatttcctagtctctttacagcaaataacaagactctttcatgagaagtactacagcttgaaagttctctttaatcatgtttgagtggtattgatatccatgaatcaagccttttactccacctattcaataaacatttattgaatcagattcagtaaacatttattaaggttctaccacaaactaaggactctgctggataccttcctaaatactatgtcagtttggttcccaagaacagatttctggtctggaacaggaataatagtcacacattccaaattggttgaaatcaaaggaactataatcggtaattcaataagacattggaacaaaaaaaggtgaaatctgcgaattatgtatgaccaaaggtattccttcagttcagtagatatccagatatccaaaattcaataaaatttagtctatatatctaggaggaaaaaataatagttaaatataacagcacaattattactcttagccttagaggtatggatagattgtcacgtggaataactattatgtaaaatgagagcattcatttggactaaaatggaagtactctttgaacatgggaaaccacaaacatattccaaagagcaaaggactgatatgaggagtccagaagaaactataaaacagtaatttctaaactattgctcataatgtgtcacaagtatttcaacataagccaatcagagatccacggagtaacaaatttaaacaaaaacaaagaaaatatgttaacaattttgtaaacagcagctggttcagatatataaaaggaccaacgtggaagtcaccaccaaacctcagaaactcctccaagcaacctaactcttaacccaacttctgacaccatgacctgctgccagaccagcttctgtggatatcccagcttctccatcagtgggacctgtggctccagctgctgccagccaagctgctgtgagaccagctgctgccagccacgcagctgccagactagcttctgcggatttcccagcttctcaaccagtgggacctgcagctccagttgctgccagccaagctgctgtgagaccagctgctgccagccaagctgctgtgagaccagctgctgccagccaagctgctgccagatcagctcctgcggaactggctgtggcattggtggtggcatcagctatggccaggagggcagcagtggagctgtgagcacccgtatcaggtggtgccgcccagacagtcgtgtggagggcacctacctacccccctgctgtgtggtgagctgcacgcccccatcctgctgccaactgcaccatgcccaggcctcctgctgccgcccgtcctactgtggacagtcctgctgccgcccagtctgctgctgtgagcccacttgctgaaagccagtttgcttattttcaattgcctaggtcacagtgtctctgaactgttcatcccttgaccacctctggaccactaacaagttctcagactttgcattgcttgtgatggagactactaagtatatgagctcacaattctatctgattccattctacaatgaataccttgacccttcactggggacacagaaatgctacaaagccacctgctgatcatcaatttgcttgggatatactatttctgatatttctgcaggattaaaaattactgacatgttgtggaatttatccatgagaactatccacaagtctaatgtttccatgctttataatctattttatcttgtttacctaaaattttttgcaacatcaaagacaccaaattatagccaagtgacattcctcaagtcaccagagagaatggaagctcatcacccaacattcagcttctaagaagtaggctggactttccacattttaacatctgatccatcccttggtttttggatcataatgatcttgcctgctggatatttcagttatatctgtgatacaatgtcttctgtcatttcttaataaatattatatactaggcaaagaaaccattgtctttgttttcacttgtacatcacctggtttaactgcttataattcaagaatgtctacttgaggccaagagcagtggttcacacctgtaatcctagcattttgggaggctgaggtgagtggattacctgagctcacgagtttgagaccagcctgggcaacatggtgaaaccctgtctctactaaaaatacaaaaaaaaaaaaaaaaaattagctgggcgtggtagtgcacacctgtagtcccagctacttgggaggctgaggaaggagaatcgcttgaacccaggaggcagaggtttcagtgagctaagatcatgctactgcactccattacactatgcaataaactgcagcaagctctcaaaatggcaatttcctatatatgacaccaaagaagacataaagtgcattaaaaagttaagtaatggtaaaaagacacatatttccaagtcgaaagcaaatgtgggagcttttcttttattgaggatcattggccatgtaagggtaggtggacaacgaaagggatgaagcaagatgaattaaggtatcgaaggatggagacaagaatgaaaagggggagaagagaacaaaatataggagaaaagacagagagaagacacagtgaaaaaggctaggtatgagaggctgaaagaaaaggaggaagagtgatggagaagacacacctgaagggaaaggaggtgaaccagcgtggccttgttagtaccatatgctgtgcatgtgccaggtacacatcatgcgaactttgcttcacataacatctatactgatcctgtgaaatagatattgtgatcctggcttgtagataagtaagtctaaaagaagttaaatagcttgcttacagtcacatagctcataagtttagaaacaaaactgaaatctgaatgcaactctgtctgactccaaaatttatggagagaatgaaattaagaaaatagatataaagaaacgtgtgggaaagtttgtaagatttaaagacggctatttcagagactgtgggcttcagaataagttactctgtgctgctggttaagttgtggtctcagaactccacatcctccctacgatactcagctttatgatgttagtgatgaaatctgcaagccacattgttgcttttccagctctccatattaggccttgctccagccagccagcaccccatcctcagaattctgagtcaggtccactgggactatcctccaagttcagagccatcagaatatgtcaagaaaaaatatgactgtcagttctgcaggacccagcctctaaacttacacattttaataactcctaactcttccttgttccttcaaccctagggtcagtagctgcttcctgtagttgctacttccgtgttcaaataattggcatggattttgtctcctcactagatgctgactgatagaaaagttgttaccaggagtggccctggaaagtagaccttcatagatgggacttggggattgctttggtaaagtccctgagcttgaacccagtgttaaactccttgccaataaaaaatgaaatgcattgcatgcaataacatcaccattattacttttgttgtttaaataaagcacctattgaaataagtggcttgggggctcaagttgctgctgctcttgactattaagacagtcatgatgattataagcattgttgtggaggatgtcttctgagtgtactgtgtgctttcagaaagaaaaatggcaaattcaagaccttaatatctcaggtcaggtcataatcagagatacagaaaagattcagcagcagccctaaaataataacttgtttgttatagccacaggactgatactgccccatattaaacactaactaaatttaattgtgtgagttgcataattgaaagttaagctgaattcacagcttcaacaagactgtcatgtgaaagttagggaattgataaagaagaagttttagaattgaaacctggcataaggatttctgtctgaactcaaaggggactgaagatcttgaatctccaagtcattctgagcctcctctaccagtaaaaatagatttccctcctgagtctgatgagaacagctgtccactgctggaaaatcctctaataacctcacttgggaaatgtacttatatggaatgcctattgtgctgaatagccaccataactataaatttttcctactagtcctgtatttctgatcacatttcagatgctccatagggcaaatacaatgtatgatccaggaaaaatagctcatacatgaaaaaacatgcaataggccaaaatccagaatactgacaacaccaaatgctgacaagaatatggagcaacaggagttctcattcattgctggtgggaatggaaaatggtacagccactttggaagacagtttgatgttttcttacaaaactaaacatattcttaccatacaatctggcaagcatacaacttggtatataccttaaaaagttgaaaacatatgtccactcaaaaacctgcatatggatgtttaaagtagctttatacataattgcccaaacttgaaaacaatcaagatgcccttcagtaggagaatggataaactgtggtacatccagacaatgaaatactatttagtactgaaaagaaatgagttatcaagtcatgaaaagacatagatgagatttaaatgcatatgactaaatgaaagaagccatttgaaaaggctaaatactgtatgactccaagtatatgacattctgaaaaaagtaaaactatggagactaaaaaaatgagtggttgccaggggttggggtaaaaggggtggaataggaacaacaaaaaaaggattttagcgcagtggaactattctgtatgatactataaggtgggtacaaattatgtatttatccaaacccataaaatgaacaacaacaaaagtgaacccaaatgaaaactatggactctgggtgattatgtgtcaatgtagatttatcagttgtaaaaaatgtatcactctagtgggggatgctgataatgggggaagctacacatgtgtgaaaacagggtatataggaaacctgtgtgctcgattttgctgtgaactcaaaactactctggaaataaagtgtatttttaaaaaacattattgtattattatatattagcagaaacctgaggaatatgtgtaagtgtatttttggggtagtaaaccaaagaagatggaatatgacactcttatagtctcacttggggaagttgcttatatggaatgcctaaatgacgtggttacacttaaagattctggatgtaaattttttgtacaaagaattatttgatttgtttgtttaaacttgaaatcaaccatggcctatgtttactgatgctcagatgtcaggacttttttgacataacataaaggaaaggaatcaaagacttaaggagataggaattttggagaagatttatcatgttacactgcacacatacgcagcaccaagtaacttcccaaaagtcccagagaaaactgccttcactcaaggattttatattcatgggggactcttgcagtagcctagatatgatggtggagatactccctctccttgatttcagtagagataataggatctcagagcactggaagctaagtcacaaaacttgactaccaaagtaaaagtaagtgcagttggcctgtttgaattacatgggtccacttacacgcagatttttttcaaccaaacactgattgaaatacagtattctcaagatgcaaaacttgcatatatggagggccaacttttcataaacactccacagggctgagcgtgagacttgaatatgtgcagattttgtatatgcaggaggcctggaaccaatcccccccacccagtacactgagagacaactgtacattcactgtaaagagaaacagagatatagtggtagccagaatgctttgacccacagggatctgtcagtagatagtttattatggtatccttggaatgaaattaaggggaagcctattaaaatgttggttgatatctatactcagatattcaggggattgtattagtttccaaatgctcctctaacaaattaccataaaattggcaacctaaaacaacacaaatgtattatctcacagattttgtgggtcaggagtacagcagggcatggtgagattctttgctcttggtcttacaggaataaaaccaaagtatcagctggtcctcatctgaggctcagtcttcttccaggaattgttttgttggcaggattcatttctttctcatgttttcatatagtcccctccatcttcaaaccagcagtggtaggtcaagttcatgttatactttgaatctctgatttcctaccctacccccacttccctctccaatatcctcttctgctgtcagctgggaaaaaaatgttccgcttttaacggcacatataattacactggacacacctggataattcaggctattgtcactatcttgaagtccactgattagtaaccttaattacatttgaaatgtcccttttgttatgtagcagacatgctacataacatccccaagtcccatctatgaaggtctactttccaggaccactcctggtaacaacttttctatcagtcagcatctagtgaggagacaaaatccatgccaattatttgaacatggaagtagcaactacaggaagcagctactgaccctagggttgaaggtacatgaccttgggtcatgacacaagggctcagaggccttggaggctgaaattctgccaatcacaggaactattagacactaagttgacactaatttctagagacccaaatgccactggtcctccaaaaaaaagtggtgacttttggtggccagatgatagttagaatcttggtctacgtttgaatcacagtggacccagtgggcctgcaggacaattccccaatttgtgaatgtataattggaataatcatgtttgacaactggcagaatccccacattggcactgaggaataaagctcatttggtaaaaaagggccaagttgaagcccccagaagtttccttgatacaagaatagtaaataaaaaataatactatattgatgggaaaattttgaagatgggtgccattatcagagacttggaaaaagctgggttgtgatacctaccatctccccattgagcttgtttatcccgtagacaaagcagataaaccctggagtataacagaacaattatgtattattattttaaatgaattcaggtgatgacctcaactggagatgatgtcccaaatgttgtatcttgaatggagcaaattaagacagcccctggcacctggtatgcagctattgacaagaaaatgcatttttctctgtatcagggcagccagaagtacttttctttgacctggcatggccaacagtaaccttccaagcattgcctcagggctatgtcaactatcctgctctctgtcctaatatactcatgctattaatcatcttgactttccatacaacatcataacagtccactacatcaatgacatcttgctggtgacatttgatgagcaggaagtaacaagtaccttagaggacttggtaaaacattaatgaactccagggcaagaaacaaactctacaaaaattaaaaagctcacagcctcaatgaagtttcttgaagtcaaattgtctggaacacactgacatatcctttccaaggtgaaagaaaaactgctgtattttaagctaacttcagctaaaaaggcacaactcttggtgggcatttttgtattttggggtcaacatatgccatatttgagtgtgttatttcaacccacttaatgaataactcaaaatgctgctaggttttagggcaagagcaagagaaggctctaaagaaaagtcccagctatgggcgtggtggcacgcacctgtaatcccagctacttgagaggctgaggcaggagaattgcttgaacctgggagacagagcttgcagtgagcccggatcacgccactgcactccagcctgggtgacagagcaagactccataaaaaaaaaaaaaaaaaaaaaagaagaagaagaaagaaagaaaagtcccagctataattcaagctgctatttcatttgagccttataatccagcacatccaaccatatttgaagtgtctatggaaaacacacgctcaccgtatatagcctctggcaagcatcaatagaagaattacaggtcagacttataaggttttggagaaaatccatgccctcctctgaaaataactactgtccttttgataaactacttccggcttgctagtgggcaagaactggaaaaaatggaatgactgtgcaacctgagcttctcatgcttagctgggtgttatctacccaccaaactataaggctggatgtgcacaggagcaatctattaaggcaggggcccccaacccctgggcagtggaccggtaccagttgtggcctattaggaaccaggcagcacagcaggaggtgagccactggccagaagcattactgcttgagctctgtctcctgtcagatcagctgtggcattagattctcatagaagcgcaaaccctattgtgaaccgcgcatgtgatggatctaggttgtgggctccttatgagactctaatgcctgatgatctgtcactatctcctatcactcgcaggtgggaccatctagttgcaggaaaacaagctcagggctcccattgattctacattatggtgagttgtataattattacattatatattacactataataataatagaaataaggtgcacaataaatgtaatgcccttgaatcatcctgaaccatcctacccacctccctggtccatggaaaaattgtcttccatgaagccagtccctcgtgccaaaaaggttgggggctactgccgtatgttataccccaagctaagtaagcttcatattaacctaatttcattgaatacttacatcaatcctgtaaaatagatactgttaccttacctttgtagatgaggaaatcaaacctaaaggcggttcaatagtttattcataagtaaaaaacagaaatacaaacccaactctgaccccaaaattcatgatgagaccatgaagttaaggaattggaagtaaagattggtgttgggagattcagtagatccaaggatatctccttgggcagctgtgggcttcagaataagttcctctttgtgcccattatgttcctatttctcggcttcaaggcctcccttctgtactctgcaaaacacactgtggctttgaccgcagttctgttaggcttttctactagggggtgacagaggaaaactgcaaagctggaataggaaggcaggatttgttccttccttctgctccatttgggacttcctgtatgctaagcagatcccaggataatcgccccaagtcacacttctcactccagcaggtgcagatcctgcccatggcagcacacgaattcagtttgcagttttctcaacacttgaagaaccagcttcattgtctcctttccagggtcaccaggaccaaccagtcctctcttaaaacaacagtttcagcgctacaggacatctccctctctaaggtttaattccttgcctcctgcatttaaagctaggcctttaaagcttccctggaaaactagggctttctgcagtttccacatttgtggtattttagggtcctctttttttacctagtgaacagcttaaaaattattcttatgaattttattcaatagaaaaagaaagggtttggttctcatcttctgcgggaccctaactgttatactcttactgcctttgaaaaattagattatttagtgagccatttgtacagaatgttcacttactccctttcattaatcaccatagtggattatgagaaaaaaattatatctgagctttggagatggcagtcagagaattacagcattttagacctgttagaatccaattgagaaactagaaagattactcaacaacattaagctctgtagttaagaaagttccaccttttctatcaaaggccttccatgaaaagtgggatgtgcccagagacctgactgcagacggccctttgttaatgactgacttatccccagaatcataactctgacttaagaaacctattctccatcatgattattctgttaagtgcgattagacagaattagttttaaaagctcaaagacacaaagggatgttgagaaacttgaagggagaaaatgttgaatcatcacatcaactaaagcatgaaagccttgggtaagaccggagatttgagagtttagtaaaattgttttgtgaggttgagagagactaatccaaagcaccaactattatgagcctatgttgggcctattcatttctaagcacgttctcttttttcttctttgttcttgcattacaaatatgggatagagaaacaggagtggtagaatacacaacatgaaaatcaaaattcctggcttttaatgggttaatatttaacatacaaaatttcgacttttattttctcaattttttaatatcttatttattttagttgcatgaatgaaacaaacgagatattttcccaaaaggatcagagaaatcttggtccaaatggggccagagtaaagaactacaattatgttatctctaagacagtactgacttgttcaaaagatgacacctgtgaccctggaaaaaaaagatcctagtgggctgataaccttacggtaggaagaagggaaagaactcaggattttcagagcaactgaagccaggaagcatgaggaagtttgagaagagttagagatggcagaggttgacagcaacagccacaaaaaactctgaacagaaggaaattcaacgttctctattcaggagaggttgagggagacaaaacaatagaatcctagagatagaattcaggaaactctgaggttaacatttttgccctttactccaacgcttgttggtttagtgatcagaagggaccaaacagaaagagaactgcacaaaagccagggatagtagttagagggaaccagaagctgagactagaagtcatacaaaacacttgttttgtgtgttaacgtgtactaagcaaaacaaacttgttatgttgtttctcaggggtccccaagccccgggttgcagagcgatacctgtccctggcctgttaggaactggatcacatggcaggaggtgagcagccgaggagcaagtgttcccacctgagctttgcctcctgtcagctcagcagatcggcggtggcattagattctcacagaagcgcaaagcctattgtgaaccgcacgtgcgagggatcaaggttgcacgttccttgtgagaatctgtctgaggtgggacagtttcatcccaaaaccatcccaccttcatcccacccacagtccatggaaaaattgtcctccatgaaaccggtccctggtgtcaaaaagaatggggactgctattgtatttgagtataggttgacactttaatcactctgaagatgtttttaactgtaggaaggggcagagagtgggatgagaaaggaatcagaagacctgagtttaaaatcccaactctactcactcactgactgtgaccttagacaagtcttctcagaagctcagtttttgtcttctatatcaaatgggggttctaatatgtcacagtattgctgtgaataacaaataaggttattaatagtaatatgcctggcatatagtaggtgctccagaaattttattttctattcctcttctccactcaagtgtatgtcttcaggagcagaaagcccttttggctatggagaggatagcatgagccagatagtcatgtgtggaaaatagctttaaaaataggaagagcattgctcagggtgatgttgtattccatttgaataaaatggatcacataaaaatggtcatctcattctcagtccaagcgcttcatagtaagcacagttttcatctatatgttggagccttccaaatcttcacctccagcactgagcgtggtgtactctcgaaaatcaaaacacacaatattagtgggaacgtttatctcatgttatcttcctcctttctgctcttttcatcccaatggactcagatgtcaaatttccactcaggaaaactgaccggctataattacaagctgttgcaatacatcttattctacagaggaaatttttaactgtatcaaaatataaattgtgtcacttcatgtaaatcacagatagtaataagaaagaatgaggaagaagtcacgctcaagcagctagagcatttcttcagtcccctctgagtaataaatcctgctaggcgtttgtgatgactgcctcctgaaaaaggcaacgtggtagaggggacatgaggagtgcacactgcttaccagtgatctcacagggttccagcaaagcaaggtcgaggggcacagtttgctttttggaggcggggtcttcactggttacaaaaactataatgaagactatcaacaggcaggctttccaggcgtgggaaacctaaaagctaaactcccaaatttagccctagattccctatcgtcggagagaaagaatacctgaaaatgacggggaagaaaaaagctccagcctccctctgcttatttagtaacaacaatcacacctattagaatcatttattgaggacttactatgttccaggcactgcattgcacattttaatgctttctttaatttattctttaaacatcctatcaatgtgatagtaacattagccatatttacaaatgacggagttaaagaggtaacttcctgccttagaaaaatatataccagtggttctccatgggtctacttaattcaagttcaaacacctcatcctggggtcaagactctacatcttgcttttatctcacacaattgttctctagacacagcgcactattcatggcttcctaacaaccatttgttcttttccacttctatgcatttactgctgctgttccctatagctggaatgccttcctactcctctgccttgcattcaagccctgtgtaccctgcgaatcccagtaaattctcagatatttaagagtacaccatgtcctgcttgtccttgaatgccttaaatctcctagcacagtacaaagcaaacagcaggtgctcaacagagataggttgaaataaaccaagttatatattttctcttgaaaaatgcaataatcaataatagagaaattataaactaatgtatagtgactaagaatgcagactctggggtcaggtggccttggttcagattttaattccatcacttaccagctattgactttgagcaacttacttaaccactctatgcctcagtttccttcagctatgaaagagaggatagctttaataccaacctcatagggctgtggtaagaattaaatgacatgatacgtgtagtgcacttttaaaaaaatctgtcacacagaaaattctgtatgagaatttgcccttaccatatagccaactatatgtttagtaaaataagctaaaaactcaaagtatattttaaagccatagtgtcagctaatatttaaatacataacaattaagtctcttcaaaaaatttcaagtactgcaggagctctttggaaaatcagtggtcattcaattcaatacagtagtcagatttatctaatcaatggagaaaaaagtctctgattcaaaataaatttataaagtacaactattgttagaaaataattccaaggatgaaaattccaaagcttactctagaataattgtaagtttaaatatctcaatacttcacatagtaggcagctgaaaattttattttaccagtgcctggcatatagtaggtactcaaattttatggagtgtctattttcctaaacatattaattttagttaacacatatttttatatattagttaatcataaagaattatctgttactatctgtatactccacagcctacaataatacataagaattaaactgaaagcctagggttcccaggaaaaataggtaacacttccagccagctggctaagcaatcacttgcaagaatgttgcatgtgccacgggactgaaagctatgagatcagccctgcatgttgccagatgacaattatagagactatcagatgtcctcaagtggaaaacaccactacttccatttaaaagaaattcaatttgggggtaattttcagtgcaagctaataaggtgatgagatatatcaggcttgactataaccacaaactggaaaaaaaaaaaatctgatgcaactggaaaacactcccaaagttcaccatttaacccaagcccagaatcctttgcatgaattttcagcatatagcaaagtaaacaaagaataaattgatgtcaatggcagccttgataccagccattctttctttcaatctatactataaaggaatgcactggcagtttcaaagatcatgcaattcaggaaatgaagaccaaatgtttttatttactagacatttttattaggatgacaaactttaaaggtttctatatcctgcttttgtgaagggatgaagaattccaacaggctttaggaaaattgagtggccctaaggtgtgaagcttcctaacatccctgctgactcaggaggtgacactgtggaaggtgtttcccaacagccacccacaaattcactgagttgttgggagatggatattcgtaaggcacaaagtggctcacagcaaaacatgactaacgcacataaaagtgactatctcgttctcagtccaggcacatcattgtaagcaaaatttttcctgtatgttggagcctcccaaatctgcacgtccagctctgctccctctcacggcttcaggatgctttgtctgtaggtcccaaactaaactcatctccaatccctttcctatcaccccagacagcagctgtttctacgagtaaatctgacacctagacatgatccttggctccacacatcctctcaatcagcatgacctatcatctccactttcaaaagggcttccaaactctaccacttcttaacagttcatcaaaaactagcatcaactgtctatcctcacactttctagtcgtgccagtttccactttgctctgctgtagttcattttcctttgaacataaggaaaatgttatcactcccttctttaagtcatccagtggatttcaacacccttagagtaaaatctaaactgtgtagaacaactaaaaaattctacatggcctgccacctgccaccttctgtaaccttatttcctattatactccttcaaaatcctacacggcctgccacctgccaccttctgtaaccttatttcctattatactccttcaaaatcctacacggcctgccacctgccacctgccaccttctgtaaccttatttcctattatactccttcaaaatcctacacggcctgccacctgccaccttctgtaacctcatttcctattacgctccttgtcttcactatagtccagccactctgaccactctaactaaggtaatacactccctggcacttctctggagttcttatttattcatttgttagttttcttattgtctgtctctcccacttgacaacaaggaccttatctgacctgtttattgctctatgcttagcacctagcatagtcttagacattttgttgagggcattaataaatttaaaaaatacatgagcataatctacaattatataaaatttaattccacaaaaatatcgattttgtgcaaactattgctattaggtgagccatcgttcactagtagtgtgactttagaatcattacttaatatccttattcttggtttcatcatctgggaaatgggtacagtaatagtgtacccaatagtgatcttaaagggttgtaagatgtaaggaagaagatgcacaataatacttagcaccatgcctgacacatggtatacatccaatccatgaaaagtgttagcagaggattagtgttcccattaccttaaaaacaaaaatattaattttattgtggaaactgctgtaccacccagatggtggtccctaaaaactgaatgatgtgataagaaatctctggtaactcccacttctctattcccacaaaactatgatatcttctaagacactcctcactcccctagaacacccaaatagtttcctaattattgtccttgtcttcaagtttcctcctttctacagcatagtcttttgattaagaaaatagctctaaactcaactccccttgtggtcccaagaccttcaatgacctggcctcatccttcctaccaatcttacactcaactaatcttgagggtcttctgcactgtagtcagacaatacccctaaagcaagagggaatctggcacagtgattaagaccatggagtctgaagccatactgcttggcttcaaatgccagctactcacccactagctacttagcctctctatgctgcaggttcctcgtctgtcaaagggcaaggataatatcattgcatacatcatcataaggttgttgtaagaactgtatgaaataatgcatgcaaagcactcagcacattacctaatacttagtaagtggcaatgataaccatgatgagccttccctcaaaaactacagtatccttccaaaatctagtcatgtcacatgcctgttcagcaacctttacataatgcctattgcctacaagataaagttcaaaatcctaagtgtaggatactaagcacagtacaaattcttcatactgtggcactaacccacctttccgtcttcattccaacagattcagaacctatgcttcaaccaggcaacactttttgtcataccatgggggccctgtggcattttgtttcaatggctgaaatctccttcctatttatttctatctgctcagctccttttcacccttcaagatccaaacagatgttctctttttgtgaagggcttcctaagttttctaggagaagtctgtggcttctacctctaaattctcatatcataacctggaaaatctaaatgtacaatcctttgttattgtttgctggtttacttctctgtgtctgtcttcttctctatgacccctgtaagggcaggagcctattgcgactttttgcatgatgcccaacatacaacaggtgttcaatcaatgagcattttatatgtaaattctaattttgatatgtaaatatctaagagagatgtaaattctagcataggaatccaaaactgcaaaatcattccaataagaaaatggctaaaaagaaagcagtttcatgctaagcatttttttaatccaacatcttgttgatttgcatctcatttggcttctgattcctctgcattgtgcaattttctactttagaacttgagccatcttatctgaaaaaatgggtcaagaaaatatgtacatgtttttaagcctttctaagtaagccatttctaaaggttttaccagtttagtatttttcatattctaaagtaattctaaatcatcatactaaattttctacctttatctacttttaaaactttatttttagagttttagtggtttagatgaaactcggaaatgtctctattctggaccacagagcctggaagtaagacaggggtgttcaatgttttggcttccctgggccacattgaaagaagaattgtcttgggccacacataaaatacactaacactaatgacagctgatgagcaaaaaaagaaaaaaaatcacaaaaaaatctcataatgttttaagaaagtttatgaatttgtgttgtgctgcattcaatgcctttctgggccacaggttgaacaagcttgctgtaagatgttgctaaatctccccaagtatgtttcataaagcactgacctatagagctaatctctgaaaacaaacaaaaagcagtccatggtcaagtaagtttggagaaaaatatatgctatatctctgtattgaaaagtcatagagcattttagcacattaaaggctccgagaggcccaacaatgaagaattcagcatttcccaaacttacttaccagaaaacactttcaagtcccttggaaccagtgttcatggaactcagtctggtaaatactgcatcatttagcttctgaatggcccaatacaaccagccttttggttataaataatctccatttataacacagttggatggagcttaaaggacacccatctttgtcacccatgaaggtcttcattcccacctgcatgttcttaccaagttattgttcagagcatatttgaaaggaatgcagaacaaacgatttgttatagctctgtttgaaagtgcctctttacacaaaaccaaaatctatttctctatagattctatccattcatcttcattcagtttattggagccacaaataataaatctaaaatgttatatcactttttcagcctgagggcctaaaggatcacatagaacctgtagtcactggtagaacagcaaacaaaaagcttacttgtcctcttcatctgaaaagtaaacaaaagaagtgggaaacgtttgcagatgcctggcataccgagccattattagtgagggtataatgattagaagataatggcccggtacctttgaagactggaatgaagatttctgtgtagtgacacactggcaatgtgaatagtcctaatttgacaacaaaacaacctaaatctcttttatgaggtgagcagtgtatcttaggtaataaacacttaagtaattaggcattttttatggaaataactataaactgaaacatgggggaaaaaccctcagtaataggctgacgcccagggagatgggtatataagagccagagcagaagagaggagcatcgagacaccaacagacttctctcaactcaacaaaaacccacctcccattgccatgtattgctgtgctctccgctcctgcagcgtccccaccggccctgccaccaccttctgctcatttgataaaagctgccgctgtggagtctgcctacccagcacctgcccacatgagatcagcctccttcagcccatctgctgtgacacctgccccccaccctgctgcaagcctgatacctatgtgccaacttgctggctgctcaacaactgtcacccgactcccggactgagtgggatcaacctgaccacctatgttcagcctggctgtgagagtccctgtgagccccgctgttaaccagccgagtctgcacaggttccgtgaggtggctgcccaatgtcctctgcaccatctgggcttcagcactcactactgcctacatcaaggctaaggccatcccaatccccggggccaagtcttgatgaatcttcttaattatttgcacatttgggtaccattggagacctcccttctgtcttttaggctatttcatcactctttgagaaataaccattttgaccatttgttaataaactttattctggcttagcaaatatgaccttgtgattatttattttcatgtctcccattagggaaagtggaatgcctacctaaacctgaacagtaggttatcacactatccaagatttaccccaacagaataagagctctcatagtggaatttatcgaaaaaatagatactggttatttgtgataagttaaaaagtaaaaaatgtggtagttcattttatagaagctttttatttaacagatatttatttaatagatattattggaagacatccactgtgcaagcactatgctagagtctagagattaacagaatgttttaaaaatacttgattttagtttccattgattctgacattgatttttctttcttccttaattgactaaatgaattgatcactgtgctggtgtgtataaataatttgattatcctagtcctcacagtcatctgaaattctgagctcaaaatgcaaagcaattttgagaagtgtatatatccatttcttcatatatgctgtcttccaaaacaatccatttttaattaatgttagcatttatcgagtattcattgattcctcaaatggggcttacattggtttacattagtcatgactatgattagaagtttgctagtctaagtgacatataatatcatgacattgaaatatgcttaaaatatcagactacagtgtagtattttctatacaccagaaatagtcacacaattctgagagcaaaaacacacagtttctattagaacaaaactactacgataaccactaattcatgtccttatttatcttagaaaaatctaggtgcaattaggtctttgcaaaaaataaaggtattgtgattatatatatatatatatatatacacacacacacacttttggacttgcctttggcctttgggccaattgcttccctctcagtctcaatttccctgttattaaagtgatttcctacctatagcgtggtttcctacctatagcttggtttcctacaggctcagttagcttgttattactctctgccctgcttttgtctcaggattattgtgaggaccagatgccctgaagtgtagaaaccaccgtgtccacagcatcaacctgttacacatgagagactctcaccattactgccatatggaagttcccaactttctcaccaaaagacatcttttaaaaatatttatttatttatttatttatttatttccgtagcttttgggttacaggtggtttttggttacatggatgaattatatagtggtggtgaattctgagattttagtgcacccgtacccaaggagtatacatggtagctaatgtgtagtgttttatccctggcctccctcccaccctccactttttgagtctctaaagtccattatatcactccatatgcatctgcatacttagtttagctcccacttataagtgaaaacatggttttttgttttccattcctgtaatttcccactccatttcactcagaataatggcctccagctccatccaagttgccacaaaagacattgtttcattccctttaacagctgagtagtattccatggtgtatacataccacagtttctctatccactcattggatgatggatacgtaggttgggcatctttttatttcttgaaatatgtatttttcccaaatggctttcttaaaaatgtttattaattccttcatttgtgttcataaatacatttataaatatcaattaaatgtttaggattactatagaataacctttgttaccatgccaagttaccttttttctagtcaaaaacaaagaattttcatgttttcatacatgctagtaagggataaaaattagagtttgtttttaatacctaaaataactcgaagttcctattactactaccatggtctttagcattcacgggccctggcctagttataaatccccaactggaaaccagaagatgtgttgttttagtcctggctctgccttgagctgcctctgtggccctaagcaagtcaattaagttcttggggtctcaggtgttaaagcagtaaaatgggttggttgatcacaccatctctaaggttgcttttcgttttaacattctatgattctagatcatccagaagcattctaagtaacaagtaccccatgcaactaaccaagcccattctacctcattacttttactgctttcattaggaatagctcacactgagtgagtatctactggacatactaatgaggtagaaggtgggactctactccagaagcggggctcagatactggaccaaattgagggctagctaaaacaggatggggacagaaacagctttccaatcagacatgcccaccagcatgctgtgtcaatttaccattgccatggcaacacctgagttaccacccctttccatggcaatgacccaatgacctaaaacttactactccttcttagaaatttctgcacaaaccactctttaatctacatctaattaaaagtaggtagaaatatgcaaaactgccctgagctgctactctctgcctacagaggtagccctgttctgcaggagcaatcacagagctgtaacactgctgcttcaataaagctgttttctacctctggcttgcccttgaattcttccctaggcaaagccaagaacccttgcaggctaagccccactttggggctcccctgccctgcatcactaacaggtgaagaaaggccactaacaggtgcagaaactcaggctgagaaagactaaattacttgcaaaagttacataaatcataagtgagagagaaggacttaaaccccaaactaagtccgaagtcccttctctttccactacaccaaagcactcaccttccccacagacagcaatatgtcaaagagaaatgtgactataggtggctctctttattcaggagaaagtatatgacacttgacaatatattctctactatccctgtcaattgtatcttttgttgttttctctgttttctctgtggtgattatagtctaaaataaaatgagtgtatacaatgagtattaaaaaaggtatccgtgtttctaagttaagaacaaaccttttttaaaaagtcagactttactgattagcagtgtcagcagagaagaaatattggctgcatcattaactttgaattgaaatgcagaatgtttggcaactcaaacacattttcagttcaacttcagcatcaataatcaaggtaaaacaactgcccttaacattaataattgtttatccttgataatataataaaaaacaagatatttcatttttccttcaaattgttattgaggccaggcacagcgactcgtgcctgtaatcccagcactttgggaggctgaggtgggtctactgtgagtccattaaacttctttcctttataaattacccaatctcgggtatgtccctatagcagcatgagaacagactaatacagtatggatgtgtctacatgtgagtaagtggaaaactacactgacaccattttgaaactacaacagaaagcaagtttgaatgcagcaacacaactaaataaaactgaaggagagctcatcccctgtctgatacataagaagttagtgagttatttttacagaattaggtaaacagcaacaaggatgttccgtccaacattctgatggacagaagccgtgttccctgagataggtggatataaaagacccatagaggacaaccttgtagaagaaagccttcctttgccacaaaacattgtcctggtccactgtcactatgtcttgctgtgattcctatctccaaggatgctgcagcgtccccactggcctggccaccactatctgcccctctgacataagctgtcaatgtgaagtctgcctacccagcacctgtcctcatgagatcagcctccttcagcccacctgctgtgaacctggcccctgcctggctgcatgcctgactcctatgtgccatcctgttgactgctcaacaaatgccacccagctccaaccctgagcgggctctctgtcaccacctgcatccagagtgtgaaccaccttgctgctagccaaagagcttgcccacattaccctgaggaccttcagtagtcattaagcgctgctcagcaaatggcctttaatgaggccatttggaagaaaatatagcactgtgccttcagttttacagaagttttcttttcctgttttgaacaatgatttcaaatgagaaatgggaaaaaaaatgctaccatggatccccttacttcaaaactaaataaacaccactactccccaaaccacatactgcctcaacatttaatgctataattacccaacgactcttgacacatgcatcatgaacttaaaaatacatccagcagaattacactttctgatgacatcaacataaatttcatagccaaaaagaggcctcacaggcatacgtagatacctgaagaaaactgtgaggatagtgaaatgcattaggctctaagcttagaatcgttttaaatgccaaggtcagcatctacctttgatttttattttttccctgcctctaaataaactcacgtgtccttaaagaggcagtgaagctagcaatttgagatcaacatgctcacagaaaggacctcaaagattgagccaagcccatttttttcgctgtctcatttaggtaaatctttgaatttaaaaatgttggccaggcatggtggctcacgcctctctaatcccagcactttgggaggctgaggcgggcggatcacctgaggtccggagttcaagaccagcctgaccaacatggtgaaagcccgtctctactaaaaatacaaaattagccgggcatggtagagcatgaatgtaatcccatctattcctcaggctgaggcaggagaatggcttgaacccgggaggcagaggttactgtgagccaagatcgtgccattgcactccagcctgggcaacaagagcaaaactccatctcaaaaaaaaaaaaaagttttgacaactgtaaagcaattcacacaaaaaatgaatcactctctttatataaagtgttactgttataaaaggccattataaaaataaataaatacctttttaattctaatctgaaatgtaatccaattcaacaaatatttatcaaatgcctaccctgtttcaggcattgtcctaggtgcttgaaaaagacaaataaaactaacatacgattaccacttccaagaaccttgcattggagtgaggaaaacaaatttaagtgacaaactacaaaatatagcagaaagaaatgaggttgaaagggaagaataggcagcccattttgtgagagcagagaaaaggatgcaaacatctagaagaatcacctagagtttctttatgaaggggatgtttggctgaatcttgagggatcaacaggatttggaaactagagaattgggaaaggtcactttaagctaaagaaacagtatgaacgaggtcacagagggtaaagtacctaggagactcccgccttcactttatgtaatgtgctgtatgattaacatatgcgtgactcacatagttatcatttttgtgatgagaacacttaatccattctctcagcgtttttcaaaaatgcaatatatggttattcactatagtcaccatgttgtacagtagatctcctgaatctatataatatttcaaaatcgattttaaaagagaagtcagagagaacacagagaatgggagagggtcttcttcatatattctacttgccaagccactggcttctagatgagagagactggtaagtcaagagtaagtaaacattaaacatttccttgacgatttcaatactagttcattaactttgaattttataatatactgggaaagccacttgaatttgcttatctgttcttcagtggtaaagtgcaggtattgaggcaggagactagcaaagggaattaaaacttggataaagggtggagtgaataaaagcagagaccagaagcaaggtgaaggggcaggtaagcaagaagcaagataagaagcagaagttagaccaggcgcggtggctcatgctgtaatcctggcattttgggaggccgaagcaggtggatcacttgagatcaggagttcaagaccagcctggccaacatggagaaacacccctctctacaaaaaatacaaaacttagctgggtgtggtggcgggcacctgtaatcccagctgctacttgggagtctgaggtaggagaatcacttgatcccagaaagtagaggctgcagtgagcagagaatgccactgcactccagccaaaacaaaaagtaagatagagaagaaagcaaggcccccatggccggcaagataaggaccaaaccagtaaggggcaactcttcatggataagcatgtgcattaaagagaaaacgtatccttaacatgaccttgtatgaaaatcagctcattcaggcttatgcatatggactgcatatcatgtatgtacttaaaattatgggctggaggtggtgcgcaagcacacaggggccaaagtaactaagcaacacacctgtcaatcaaagaggcaaacactggctagagattaggcagccttgggaagggacacacacacacacatacacacacacacacacacacaaagacgcaaactgcaccaagctgggggctgatctcatctcacagaggctggtttgctctccccctcttagagtgtaatactgtgcttaatacacttttgtttctttgttttgctgtgggtgtctcgtccaattctttgggacaccaaaagcctggaactgcatggcaccatctggtaacagtatgatgttcgacacccttggcatttgttgtaaattcctgctaataaaaatgatttgaagctgttttctgtttttttgtttttaacttttaagttcaggggtacctgtgcaggtttgttacataggtaagctggtgtcatgggggtttgttgtacagattatctcatcacccacgtattaagcctagtacctaccagttatttttcctgatcctgtccctcctcccaccttccaccctctgataggttctagcatctgttattcccctctatgtgtccatgcgttctcatcatttagctaccacttataagtgagaacatgcagtattcggttttctgtttctgcattagttactaaagataatagcctccagctccatccatgtttcttcaaaggataggagctccttattttttatggctgcatagtattctatggcatatatgtaccacatatttttgttgttaaagaaaaagataaactggttgttttaacgtataacgtataaggcttacctaccaatgacatttgatattttccactgattttagccagctttcttctcttttaagtagatcgtactggtttttggtaatgtcccctcagaaacaacctacccggaatctttgctttctgttaagtcaacaaattgccacataacgagtatgtaatttaaattatacaatattatctgaaaggatttgtgctgatcatggacaggtgtaggaagatgttggaatctagaatattacacatttgatattatctagttcaatctctggctgacttaagtaaataatgttgtttaaggcatacctcaaaggaatttcaatctagttcaagatccaaggtatgaaaacaaataaacatgcaaagtagggagtaagtcagtgaaaaagtgatttttatgaatgccatagttctaaattgcattgagtcagattccctgccaaaatccatgattgttctgtgactcttgtggtttctccttttaattcttatttcatcttattttaaagtatgtacaccattcatgtgaaaatgaatcaaggctgaggtggttttcttttagtggtatattcaacaaagaatggccactgtgtggatccttccttccaatgaatttatactttgattcaccacaagattggcataactttgagaatagagactattttagaaaaaaaaaatccatagaataatacaacattgagaaattcactacagatttaataaaaataataaaaaggagtttcttcatcctgtaccattctaccactttgcttgctcaatagaacctgaattataatatcactaaataatgcaaacatgtccgagatgcctgtagtcacatgaaacattcatctgtaaatagccatattcttgttgactttattgagttgaaaatggtccagttcatcatttgagttactcattctgaaattagtcattagaaatcacattatccatagtattttaaattaagagggaaaaacaagaagagtttggcctccaaaattacagctgaattgtcacttggattgattacccataaaagtcatataaggtttggcatgccagaaacctgtgaagacaaaatgtgatgatcttgtgacaaaaatgacaagtcaatgagtcaaaaatatgattaacttaataagagcgggaactcttaatggacatgtaaatgacaaactgattagagaatctcagtgaaaaagggtgccataaacaaaacaggaaggcttccagttggaccaatgcccacttgggagggtatataagagccctaacaaaagaggagacatttgtacctcagaatcctcatctaagaaactgaaagctaaccagacgcccattgccatggattgctgtgcctctcgcagctgcagtgtccccactgggcctgccaccaccatctgctcctccgacaaatcctgccgctgtggagtctgcctgcccagcacctgcccacacacagtttggttactggagcccatctgctgtgacaactgtcccccaccctgccacattcctcagccctgcgtgcccacctgcttcctgctcaactcctgccagccaactccgggcctggagaccctcaacctcaccaccttcactcagccctgctgtgagccctgcctcccaagaggctgctgatggatggctactttgctcagtgcccgacaacgaagaatccagaagctgtcccttcagtattcacttgcctcagtagtttgccagatgttaaggtagaccagatgacccagatatgaagaacttacctttggttttaatgggggaaaaaaagaaaagtattttttatggttatttagctgaaaaaccatttggttcctgtgggcaggtgaatgagttttattagcaaaatactgtttcaatctttaagacctcagattacatgttcttgatcatattgcttcctggctcttgtttcttgtactgggtattttcatagaagaaaatttcttggtgggttttccaataaactatatttctctggcaagatgtgtcatttgtttatgttagttttgggtatatttcttccattttaaaaaggtaaaaacaggatgattattttaatcttttaaagaagactctattggcagaatgactaacattcttgctactactaacatggcttgctaacttttaacaggttctctttcatgtttgccttctcttctctcttcttcctcagacaagtgcaattttggtgtgaaccaacatttatttatctactcttcaccagtaaattattgatttagtccttaaaacagcactaatggataagaaaaaatgaagttttaagcgttattcaacattctgaaagtcataaagttaattacttagaaaatcagaattcagcctcttgtatgtctgactctaaagcccaatttttcctaccacatcatagaaccttcaatactaatgaaaccagaagcttaatgagcacagttatgaaataaacccaaaatatgcaagagaaataaaacatgtaagattctttaacaaaatccacatcggattataatagaaaaagagtacattggttcatagattaaaattggcaagtattcaattctaaaatctgggcattttgaaggtgtacctatttcaacttcattttctcttagagagaactcaaagtggtcaactctagtaacaaggcaccagggacatacctttatttgccaccatactcagcacagatgttctaccacagtaatcaatagaatgccaatacttttcaggtgtctcaggttgagagctaaaactctgattacgtatgctttaattcgttacttaattttatcaacctacttaattttatctcatgaagatttttcttttccaagcctagagagaacaagtatatattatatatataatacatccaatacatttatgtaacacatataaatatatgtgtgtatgtatatctatacacaatacatatataaagacacaagtcaaaatctgaaaatgcattgaaataaaaccacaagaagacatgcaagaaacagagtaggacaaggaaggggagaagcaaatgctttttaacaaacttgttttaaaatgtcctcaatgtacctgttagtgtcttgagagagaaatttctcacgggattccataggctttttacagctcaaccttaaatgaacagaacttagcagccatggagtctatgggacactacagaggatattgtcaacaagagatctagtccattcactcattcatttgtccatatttcctgagtgtttgccctatgtcaggcatcatattgatgccaggagtaaaaagataaaagaaatgctattacctcaagtctcaagtgccctcaagtctctcccaaatctagtgaagaagaaagacaagttatcataataataattgcaatgctgagggattctgctgtgactgggaggtgagcagcatggcatgcaagcatacagaaagaataactaaaaccctgatttggtgattcagtgtcaaaggtgagaaatagctacggaaagcctctgagctatccagtctaagctttaaaagatgaataggcagcaggagaggtagggaacagttgttccagacagaatagcagcttaataaatcatggaggcagcggaaaggttggtgtctttaagccacaggaggtagttgggaatgactggatgaacaatgcattgaagagggtgaggcagagaagacagaaatgcaaagacccagacataaggggctcctcaaagcaaaggggtttggactgaaactttgaagcaatgaaatatttcaagcaagagaccaatataatcatgttttgcttctgtctcttttcattattaatctttgatttacatctgcactgtcccagatccctccattgactatagaaagatataattaaaactggacttcttggatgtgtgagtgtgcgtgtgcgtatgtgtgtgtgtgtctagatttttagcaccccgaaaatctaccatctcatcaagaatcaccatgtttttcctacattcacttaaagaaaaaagatacgcgttgtttttaaaaataaaatgcttagtatctctgacacatagtttaaacttccatttctaaccacataaaaggtagctcaatcccaataggtcctatatttagtttttaacacactggctcccgaaccatctaaggcaaatcatctcacctctctatgaatcactgtcatcatttataaacaaaggagagtaattctcaggtctcttagaccactgcagagaaaatacattttaataaagtgctgcaagtcttgtcaataaaagagaagagcttattataataaacttgttgcattacaactgtttgtaatctgtaaccttgtcttatttatgattagagaaacacaatgtgctgcataaacagtaatagttgctctaagcttttatggtgaactcaaagtaatattgtatcccaggtaagaagctgatagctttctgccatgaaattctaatcctgagggtctgcaagccatgtttcctttgtaatgtttccctcaaaataattttttcttttattttttgtcttttactctttttctttcctattataatgtataatagcagcagcttataataatatgttatgtgtatgaaaaattcttccaccaaactgtaaacttcatgagggcaaggatggtgcctatcttgtttattgctataaatccaacatttatcacagtgactagcacatagtaactgctcagtaaatgtctgttgaattactttttaaataataagtgaaatactaatcagttctaagtaaaagggtgcacacttcggcaggcattcatacaaagataaatctggggaaagtccaggaaccagaagatatcatgaattctccctttcaatcagagccatagggagcttttcaaatttttaggtttgttaatttatatgccaaccactttctctaatcgtagatgtgattatttatttatttatttatttgtataaactaatataaatgtttgctctttcctgtaaggttgctctcttacttaccttcatctcattttcttttcttcttttgactatgtttcttttatctttaccttgccttgaatttcatctgtaatttgtttcaatcatgataataatttatttttgcatagcattatatggttgtccatgagctttcaccctttttatcacatgtgaacctcacaataatcttctaagtggaggaatatgcatgctattaccctgatttcgcagagaaaaaggatgaagctcctaaaagtgaattacttaccataacgaggaagataaccagcagcaccgggaacagtcaagagctattctgactcctcaggtggtcctcttgactacacgtccccattcccaaaacatacaaacatgcacaccacaatgcaccactcaacaggtgtgcctaaaagaggaggtatgaagaatgtgagaagaaccatggcttgcaagaagcatgagaccaagctgagcggaaatggttcgaggtgtataaatgatattggccacaagcccaccttgtgctccctcttaaacactgaactatgcctgcagtctaaatagcgtactggtactagaaccaggtctttcctaccacagctacatttgatttcaggaaaaaatgcaataccttgcaaaaaaaaaaagaaaaaaaagagagagagagaatgaaatcaaatgtcaacagattaatctagctcaggctcataagtttcctttggtaataattttacttgaattttagttttgtattcttaagttattattttatttagtctatatagacagaagctaaaaattcaatttgcccacaattagcagtgaaggaaacaaagcaagccaactctcaatagaagacagatggccaatatgcatatgaaggaatatttcaacctagctggttataaaagaaatacagacacaacaatcataaaattgtgtttttcaccaatgaaattggaaaacacctttaaaataaagtatctgtcaaaggtatacgaaatgggaattcttaatcaaacacatctggtggaaatagataatttgaaaaaaaaagtaggtaaatagaaccattctgaaaaacagtatggcaatgatatgaaaggccttaaaaatactggaaattaacatttgcccctataattctaccaaataattaattctgtttctgaaataatcaaaaatatgcacaaagatttacatacagaggtgctctgttgccaaaattattgtagagaaaagtggaaaataacctcaatgcataataatataaaattttaaagtaacatagaagtgcaattatataataaatgctaagaaatattaaaagtaacactatcaaatatcctttaaaatataagataattatatatatatataatatatatgcacacacacaaaggcaagtttcagaacctatgcacaatatgattccagtaatgtaatgtaatgataaacaatgtatacaaaatattttgtagtaaaaaactagaataataagcgttttttaaagtttttccatatttcttaatggcatatttcttcatgttaatgtaattttgatcttcaaaagcctcaaagctaaaagaaagtaaaattaagttcaactctttaaaacaagaatactttatcagacaaattggtatagataaagtgacagattaaaaataaagcagcactggagagcaggcccacatattacagactcactgtcatgcaatattccccagcagggctggtgttgaaaatataataacagaaggctttggtgatacctcataaagcttgtgttccagtgacaaatagcaagggtaatcagttcagatttagcaacgaactcaaataaaagttaattaggaaaatggggactctttacagagtctaaatgtcaaacaaattaaagaataatgggtacactaacataaacaagaaccaggaaagaagcctcttggctggaccaactcccagtggagagggtacataagagccccagagaaaggagagatattcacacctcagaagccttatccttcttttcaatcaaacccataaataccacagactctaatagccatggattgctgtgcctctcgaggctgcagtgtccccaccgggcctgccaccaccatctgctcctctgacaaatcctgccgctgtggagtctgcctgcccagcacctgcccacacacagtttggttactggagcccacctgctgtgacaactgtcccccaccctgccacattcctcagccctgcgtgcccacctgcttcctgctcaactcctgccagccaactccaggcctggagaccctcaacctcaccaccttcactcagccctgctgtgagccctgcctcccaagaggctgctaatggatggctactttgctcagtgcctgagattgaaaaagtcaacatagaagctttagcattcacctatctcagtacctacaactaatgtactctgctttagaaattggaacaaggatggtactaccacaatcaccccctgcaaaaaaaaagagaccaagaaactttcaatgaccattcagctataaccaactgcagtttgaatcagtggatgcctatagcttcctgaagctgttcgattccttcatattaaagtgtctctttctgtgggtggtttgggaattctgttttcagtcttgggtggtatctttctgaaaattaaggaagttcttcatgattatcctaataaattttacatctctggcatagcacaagtgtctacaattacttctgtttatttctgttcattcattaaatgcgtttcttaactctgaacattggcatttaaagaaaaactggaaacattagtgaaactgaaaatggtggcagtatggacaaaaatttcttaattttgctgttcttgctgttttaagaaaattaaacatccttgcatgtaagatggtctagtacatcggcatatttgaaagtagacttttcctgacttgtcctcccaaaaaatggtttcagacaggttgagaaatactgaacattacccaaacaccaaatatgacaaaatatataaactaatccaggtgacatgatctatttatgaaaaaaatataataatgtcattatttattcaactaagatttattaaatgtctattgtgtgtcctgtgttttattgtctctgctgaaaataagctaaccatctggcaggtgaagcaaatacaaacacaacatccatttgtttcttcctacggttaataattatcgaatgccagttgctgtgttataataaaaaaagatgtgttctaccagcagtattagtaaagtgctgtgggatcataaaattgagaacaatgaagactgttgtcatgggggtaaagtgggaaagacatagtcaaagaggaattgactgcagctagtcatcaaagggatatggaggaaaagaaaatatcaaagaaagactagacagtggagttatgtcaccaattgagcctaggagccgagaaggagaagagagttcaagatggaaatactctgttcttcttgctctacacaggtcatgtttgcaacacgagtagctatatctaaatggggtttggaaagttattctggagaggaagaagatatacgtaggtaagtaaagaagactgtgtaaaagttctcaagtacttacagaaggcacagttgcaaatacgctggctgaaattccatcaggcatagcaaagagtggctgctgggtgattagaagctgagtggagataccagaggtcattcactattaacagactttgaggttccagcctagccagggtagaaaaaaggattgaaaaagaaattgaagaaactaagaagcctgtgggaaagtaccaagtggtgaaatgaggatgaaattggagtctcagaatgagaggagttaaagaataggaaataaaaatttgggagggaataaaagcaaaaattttcgaaatttggtgacattttattaacccatatattcaagagtctcaataaacacttagcaggataattgcaatacacacacacacacacacaccacctacacatatcatagtcaaactgctgaataccaattaagaaaaaaaaacaaatcaaatagaaggcagcaaagaaaaaatggatgtctgacttctttttaggtaaaatggatgtcagaggaaaatcaaacctcatttaaaaggtcctaaaggaaaaaaaattgtgaacactacagtctgcaaaaacaaccttcaaaattaaagaaaaaataaaaacacttttaggtgaataaagctgacttcttttttaagtgcctgaagatctacactataagaaacaataaggaagtccttttggtttaagagtaattttacctcaaagacaaaaaacaaacaaaccagttcagaaatggacagagaacttgaatagactttcttcaaagaagatatacaaatagccaatcagcacaggcaaaggtactcagcatcactcactaatcattagcaaagtgcaaatcaaaactacaatgagatactacctcccacccattaggatggctgccataaaataaataaataaataaataaataaatacaaaaaacaaaacagccaggtgtggtggcttatgcctataatcccagcactttgggaggccaaggcaggtggatcacttgaggtcaggaatttgagaccagcccagccaacatggtgaaatcccgtctctactaaaaatacaaaaattagctgggcgtggtggtgggctcctgtaatcccagctacttgggaggctgaagcaagagaatcacttgaacccaggaggcagaggctgcactgggccaagatggcaccactgcactacagcctgggtgacagagcaagattccgtctcaaaaaacaaaaaacaaaacaaaaccccttatatatatatacacacatatatatgtaaaatatataatatatacattatatatatatagagagagagagagagagaaattggaaccctcaagcattgctggtaggaaggtaaaattgtacagtgactgtgaaaaacaatatagcacttcctcaaaaaattaaatgtagaattgccttatgatcttgcgcttccacttctgggtatatacccaaaagaattgaaagcagggtcgctaaaagacatttgtatacttgcgttcatagcagcaataattgcaatagctaaaatatgaaaacaaacaagtgctcattgatagacggatggataatcaaaatatggtacatccatacaatggaatattattcagccctaaaagggaaggactttctgacacatgccacaacatgaattaaccttgaagatgttgtgctaagtgaagtaagccagcacaaaaagatactattcacttatatgctttcacttatatgaggtagttaaaagtagtaaaaaaatcatagagatgaaaagcagaacaatggttgccaggacacaagggcgggcttcatgggcagttgtttaaagggaacagagtttcagttttaaaaggtgaaaagagttatggagaaggacggtggtgatgcccacacaacatttgaatgtacttaataccactggattgtacacttaaaaatagttaaaatagtaaattttatgttacttgtattttgccacaataaaaaaattttaagagtaattatacaaaatgaagtctcagaccttcaggaaggaaaaaaacactgaaaatggtaaatacatggataaaatatgagactttctctttttccttttctcgatattctaaaagacaatgatttaaagcaaaagcaatggcattgtagggtttctatatgtagaagtaagcaatttgacaataatagcacaaagaacagaaaggggcaaaaagaaccctactgtggtaaggttctcgtattttacataaagtgctacagtattaattccaagtggagtacaaaaatgtaaagatgcatatcataatcctgagagaactaccccaccctttagaaaaaccattaaaagatatatacttataaagctagtatagaaaataaagtagaatgtttgattggcccaaaataagatgagaaataaaagggaaaggaagcaaaaaacacatggaaataaaaaacaaatagcaagatggtagattttaaaccaaccatatcaataattacattaaatataaagtaagcactccaataaaaagtcagaggatgtcagattggatttaaaaagaaaacccagcactatgctgttttaaagtgattcactttaaatataaaagcacaagaaaattgaattatgtagtctgaaaaaaagacataccacgcaaatagtaatgataagaaagaagtttggtcacttaaatattagataattttaaggtgatatttcataatgaaaaagggaaaattcatcaggtggtcctataatccttaaaaatatgacccaataacagagcttcaaaataaataaggcaaaaaatcacagaagtcaagagagaaatagatgaatccaaaatcacatttggtgattttaatatcccctgtcaggatctgagagaacaaacagataagaaaattaccaaggagaaagaagatttgaataatagtatcaaacaattttactcagttacatttacagaatgttaccccctacaattgcagaatatacattcttttcaaatgcataaggaactctcaccaaaatagactatattctgggccattaaatttgtctccataaattccaaaatctaacaaaatatgttatctgaccacaatggaattaaatgagaaatcaatcagatacttagaaaaatcaccaaatatttgaaaatcaaacaacacagttctaataacctatggatcaaataataaataccaatacagcttaagaaatattatgagctgaatgataatgaaaacaaaagattttaaaaatttatgggatacatacagcattggattagtagaaaatatacagcaaatgattatattagaaaataagatttacatctttatcaccttcatttatctcttcatcaatcacttaagttttcatttcaactaaatagaaaaagaacaattaaaattcaaagtaaggagaaagaaataaataataaacataatatcagaaatcaatgaatagaaaacgaggaaattaatgaagctaaaatttgattctttgaaaggattcataaagtacttctatttagttattttttagttggcaaataataattgtgtatatgtatatttgtggggtacaatgtggtgttttgatttatgtatgcattgtggaaagataaatcaagctaagtaacatatccatcacctaagcacctgatcattgttttatggtgagaacatcaaaaatctactctttcagcaaccttgaaataaacaatacattagtattaatctgatgaacatcaagccagattgatgggggaagcatgagataaaacacaaattaccaatatctggaattaaatagtgagaatttatagacactgcagatactaaaattcatgataaggattattatgaacaactttatttcagtatttttgcaacttaggtgaagtgaacaaactccttgaaaaatgcaactttcacacaaaatgaaatagaacaactgaatagcattgtgaggtttctataagtagaggtaagcaatttgatgtagaggtcagcaaatatacatatatttgcgtgtgtgtgtgcatgtgtgtgtgtgtgtgtgtgtgtgtgtgtgtgtgtgtgtgtgtgtttgaaatggagtctcactctcacccaagctggagtgcaatggtgtgatctcggctcaccgcaacatctgccttccaggtttcagcaattctcatgcctcagcctcccgaaaagctaggactacaggtgttcgccactatgcccaactaatttttgtatttttagtagagacaagccttcagcatattagccaggctggtctcaacctcctgcccttaagtgatctgcctgcctgggcctcccaaagtgctgggattacaggcttgagccaccgcgcccagacattttttttcctagttaaaaacaaaacacaactttttcacatgggagactcctggaagaggtggcctcactggactccatcaaacatttaaggaataaataacactaatcttacagaatttcatgaaataaagaggaaacatttcccaatttaatttatgaacagtattactccattctcacactgttataaagaaatatctgagactggataatttataaaggaaggaggtgtaattgagtcccagttccacatggctggggaggcctcaggaaacttacaataatggtggaaggggaagcaggcacttcttacatgggggcaggtgagagagagcgtgggaaggaggaactgtcacacacttacaaaaccattagatttcctgagaacgaactcactatcacaagaacagtatacgggaaactgcccccatgatccaatcatccaggtccctcccctaacacgtggggatttggggtttataatttgagatgaagtttgggtggggacgcagagctaagtcatattgtgaacccagtatgtaacttgataccaaaacctaacaagatcattagaagaaaagaaatttacaggaaatatttctcaagaacatagatgggggtggaaatccatttgctaatcctatcaactaactgaataaaacaatttacataaaggataatgtagagtgaccaagttattcaatatgattgatcatgttgtagggtcacccagatcatccctccacttccttctttgccttgggaaacagattaccttgaccaccctgtggcccagccagctgtgtgtttcccctgcagcttgaacccgagctgacccttgaacattcccaggcactgttaaaagttatttaggttgttgcccaaaacagtgaaaatcaaccaagttgctgcacgtggatactagctctggccctgagccaaatttcttaaggcctcatgtaaactcttataacctgtcgcacaaatgttaaaagcaacaagacaactgctatagcagagatgcgtgcaaagtgctctgggaggagccacatctccacatgaggcagttgaacgacgtttcagctgagtcttgacatgtgagttcatccaggaaacgaatagcagaagagcatttgaccaagaaaatagtacctacgaagcttgaaggatggctggagcttagggtttgtgagacagaacatcaggaagtgagcccagaaaggtaaattggcaccaggttagggaaggtcatatttgccaaggtagaaagtttgcattccataagtggaaggcgacaaaaagcaggtttgtattttaggaaaatgattctggcagcctaggtggatgttgtaaggtaagagcatagtattatgcaaaataaactaccgtgttgttgtcggtttttttttttatcatggcctttcatgatgtctatttctttttctctattcccaatgttcctttcttctggtgatgatatgctatagaaattgtcacgggtgattagcaactatctggggctggtggcatgggggtaagaagaatttatcaagatagttgtaggtaaagaaaggcagatatattagagaacgtatgaaaatacgttgcaaggaagcaatgggcagcacagcagagaaggggctgtctgcaaggagacaaaggcgtgctggagattttacaggatggtgcttgtactgtgtgctgaagagggtttgtgtggtactgataacactaaggttgcagtgagctaagttacatttttctatcagctgaaggtctggtgatagctgggtgcaggaatattgtgcaggagggctatgtgtcctggaccatgaagaaggtgagtcttatacattacctgctttctttctttgttttttgttttttggttttttttatttatttatcacattgtgcaggttagttatatatgtatacatgtgccatactggtgcgctgcacccactaacttgctttcctctggtcctgccagcctgacttcttttccctaaggaggactccacagaaatgaattctgggtgatttctatattctacgatggagactatagctatagatcattatacaacactacctaattaatcaagaccaaaataaatagtcctacctgcaggacaataaccagtaacaaataatttacaattagaaattagttccagacagaaggaaatatttcttattttacctgcacttacatgactgcattttagctaactggagcctgtgatggacaaccaaaacatgggttttcttcacagatatttttcttttgactcattaggttactgtgaaaagataattttctttcagagatttgtaatttttcagaagtgtttttgaatccttgaactcatatttgttgcagagcagcgtcaatataccatgagacactctaagaactttttgcataagtgttgatgtgtaaagagaatcactaaattcaaacccagctctgcccagggagtaataaatcctaagagactattttaactcacttacatatgttcttctggtttggtttggtttggtttctactatcaggtacctaggaagtagcactcaagattaggagaaaaaataagtttattctggatcaaaaattttttaactttttcagattaatctgtttttttcctataatgttcttaaaaattctagagacaattttctctatgcacctttgaaaatgaaataaatgtaacgactaaaaccaagcaaagtgaaatagattatccttcacaatggaggtgaaatccaagagataattcaaaaaaattacgtatctcaagttcctgtctgtcagatttggcaccagagatttcatccagtggaattactgatttggaacctaaatagaattttattttccaagttccagtattttcaattttcatgaaattcaggccttcataaataaataaataggagaaaacaggctctacatctcagaagaaaagattcctgtgggttccttgcccctactctgaagtataatcattaaggaattcccaagggactaaaaggttataacttagaatttatatttcactcttattaggaatacaggtaaaatagtataacttatctaacaataagcaatgagaaatgtggagaaggcaagtttcaggaaatcaaagatcataattccagctctaaccaatttatattttagcctgcagaaaaacaagttattcctatcagttatgtaaagtgacttttccatttgtacgcaggtagacatggtttgcacacacacacacactttaaacccaatatatagctcactcctccagtctttatcagcacatgctctgagatcacaaaaagcattgaaagattactaatcacactgaccatttttatggtggtggcacaaacaaataattgtcattttgtgagctgtaatactaattttaaaaggggacacaagcaatcaatccacagaatcaaaatctgtggacatattattttcctgatttgtaatgagttgtatctataattattcattggccaaattttctctttcttttattattctgtcaaaagcacaatgcttcctatgacgattttctgaaataagtgttttgtcttgcacatggaaatggtgtgggtcctgctttggtaacctaaagttatccctattttatgaggcataaaactcttcctcagtaaataaacaactctaatgagatgtttgtacgaaaactggcaccatcagtgataaagaaaacatccggtgcagtctgtaaacacccattttggggggttataaaactctcaggagaggagagttttggagtcaaggcaactgaagttttgcagccagtctctgtctttgcttctggaaggatgacttctgactgctcctccacacactgctctcctgagtcctgtggcacggcttccggttgtgcacctgcctcaagctgctccgtggaaacagcttgtctccccggtacctgtgctacatcccgatgtcagactccaagcttcctatccaggtctcgcgggctgactggttgcctcctgccatgctactttactgggagttgtaatagtccctgcttggtggggaactgtgcctggtgtgaggatggggtgttcactagcaatgagaaggagacgatgcagttcctgaatgacagactcgccagctatctggagaaggtgcgcagcctggaggagaccaacgcagagctggaatccaggatccaagaacaatgtgaacaggatatcccaatggtgtgcccggattatcagcgttacttcaacaccattgaagatctccaacaaaaggtctgtgtcctgttgccctagtgctccaccttcctgatctatggtttgctttatctttctactagaaggggctgttttacagaaggaaaccaagggaaaggaaaattctaagagttagtgatacataggggagagcaccggactgaaagtcagaaaacctcagcatcagccccagagctacccctgattactgagtgactataataaagtaacttgcctgtagacttttccttcatcatctatagaatgcagaaaaactgtattatatccaaaatcgcttttgtacgtgacactgaacatttacattatctgaacacagatcatgaaatgccatctttttaactacctagtaatcattttcttctctccatgaatttctattattatgggagaggatatactcataatacaaactactgatggagaaaacattaatggtgttcaactgcctgagaatgttgcaaaatgtcttatgttattaaaaaactaaacctttttatttcattattttgtttctaaattggctctgctttttttcttcatgaagtgacaaggttaataaaaaaaagcaggctgagggtgattttatactttcttataaagactttcaaaagatagctaatggcatagctgttggatagaagtttacttaggtttctctcaaagaatcatttatcacataatgacttgcttcccagatcttatgcacgaaagcagagaattctagacttgctgtacagcttgacaactgcaaactggccactgatgactttaagtcaaagtaagtttaatttaattttattttatttatttattttgagatggagtttcactcttgtcacccaggctagagctcaatggtgctatctcagctcactgcaacctctgcctcctgggttcaagtggttctcctgcctcagcctcctgagtagccgggattacaggcaggcgtgcaccgccacacctagctaatttttgtatttttagtagagacagggtttcaccatgtgggccaggttggtctcgaactcctgacctcaggtgatctgcccgccttggcctcccaaagtgctgggattacaggcatgagccaccacgcccggctttaattttaatttgaaaataacttatggctctctctctctcaatctctctctctcacacacacacacacacacaaatattctctatataatattttaaagttaagaatgttttaaaagcttgaatttatcattacttaggaattaagagaaattatgcacatggcttcctgaagtccgtgtgtcgatcctccatgtatccccacactttgcacagcgttcagcaaagtaagcgttggatttctcttttgctgtgaaaggtacgagagtgaactgtcccttcgccagctgttagaggctgacatcagcagcctgcatgggatcctggaggaactgaccctgtgcaaatctgatctggaggcccatgtggagtctctgaaggaagatctcctttgccttaagaaaaaccatgaagaggtaaggaaagtggcaactccgctgaaggactccgagagtaacgtacttacattgacagatgatctgttgatgtttgtaaatcgaatttgggcagatgttgtttaagctggaataaaactacttgaggcagggccaggcatggtggctcacacctgtaatccaagcactttgggaggctgaggcaggaggatcacaaggtcaggagttcgagaccagcctgaccaatatgatgaaacctcatctctactaaaaatacaaaaattagctgggcatggtggcaggcgcctgtagtcctagctactcgggaggctgaggcaggagaatcacttgaactcaggaggcggaggttgcagtgagccgagatcttaccactgcactccagcctgggtgacagggcgagactccatctcaaaaaacaaacaaacaaacaaacaaacaaaaactactcgaggcattattactattcaacctgatcattccagtgtgtctctgatttaaggtgtgaaataacccctagacagcgccagaggaaggaatcaaactcttctcctgcccttgcctttgtggaggaggtaacttcacaaatggcttcctttggaggctttatgccacccctagctccagtccacagggtatgaaaatcaggctgaggaacagactgtgaagtccatttcaaaaaagggataaagactgtgcactatctggaccagtgtttttaaatattccgcatttataaacttctaaaaatcataaaatatacagccactgatatattgataaagctagaaaatgaaaagctgaatgatgtaacaaagtacatttgctctttgaacgtttgttgatgacaatcatagctaacatttattgacaccttactatgtgtcataattaacttttataagttaattatgtgtagattgactcttctagatctcacaataactttctggaaaaatgtccaattattatgtccattttacagacgaagaaactgaggcccttctaagtggtgaaaagagattcagcccaggcaatctgaatcaaaatctcacacttttacccactgctccaaaaaacagaagtagaatgccattggatgtcaaatggatttttccccaccattctgtgacattctttacaccatcccactttcaggaagtcaacttgcttcgtgaacagcttggcgaccgcctcagtgtggagctggacactgcccccacccttgacctcaacagggtcctggatgagatgcgctgtcagtgtgaaacggtgcttgccaacaatcgcagagaagctgaagaatggttggctgttcaggtcagtacccagattgaaaaaatgtcaggcttacagacttctgccttttttgaattctctaatggtgtctgtgtttcagacagaagagctgaatcagcagcaactgtccagcgcggagcagctgcagggctgccagatggagatcttggaactgaaacgcacagccagtgctctggaaattgagctccaagcacagcaaagcctggtgcgtgaggcaaaggcagtgtccgttgtgtcactgataagtcaggccctgagatgttaagccctcttccatatccgaggatcacatttccttgcctttcccgagtactgccgtttacccagctattaatagaagcagaagtgacaggtccacagcttgtcctctaagatgccttaccttcactcctgggcttgagtctgatgctgcagcagcctccagagacagggagggagaagcagagctggagagaaacctccgggccatggtcgcttaagcattctggcaggttttaattctcatttgattcaggccagttttccaggctcactgttatatctaaaacaaagaatcattttcaaacatttcatcctacagtttcccaggatctacacttcaaccttatccttcactgcaccaccccccactcaagcaacaggaacaccatgcgttcaagatgacatgaaccagttctggtcaagcaccactgtgtgcatgtcattaggccctgcggagaacacctagaagaacaatagctgagcattcatcctgtgagaggcactatgctgatttaaggctcacagtaactttaccggatagatacctttatcccatgacacagataaggaaaactgagactcagattaagtaacttgcaaaggatgcaattctaagaggcaaacttggaagctgagttcagccagttgaatcccagagtctcttctctctctctttttaaatttatttttattgatatataatatgcgtaaattttttttacgtagatgtgatattttgttacatgcatagaatgtgtaatgatcaagtcaggatatttagagcatccatcacctcaagtatttatcatttctatgtgttgggagcatttcaagtcctcccatctagctattttgaaatgcacagtgtattgttgttaactgtagtcacacttctctgctgtccaacatgaaaacatattctttctgtctaactgtatgtttgcacccattaaccaacctctcttcatccccttaccacacatatgccagtcccagcctctggtatccagagcctcttctcttaatagcactatactacccctccctgccaagagcccaaactcaatctttcctctcatatgttgtggatagtccttaagcttcacaaatatgtcatgtattgctgtagtcatagtggtggtagtgatagttgacacgtagaacagtggcagtatggctggcactgttctaaatgctttacgcacattaactctttttttttttttttggacggagtctccctctgtcgcccaggctggagtgcaatggcatgatcttgacttactgcaagctttgcctcccgggttcacaccattctcctgagtagctgggactacaggcgtccaccaccgtacccagctaattttttatatttttagtagagacggggtttcaccgtgttagccaggatggtctcgatcttctgaccttgtgatccgcccgcctcggcctcccaaagtgctgggattacaggcctgagccaccgcgcccagcccgcatattaactcttaatcttcacaaccgtctaatgaaacagatactttgtattctccactatacagagaataaaactgagactcacagaagctaaataatttgccagtggtcacatagctagaaaagggtaagcaggaatttgaaagtaggcactctggcccgagagactgcacttcatggtcctttggacaatgtttcctcccgcagacagaatctctggaatgcaccgtggcagaaaccgaggcccagtacagctcccagctggcccaaattcagtgtctgatcgataacctggagaaccagctggccgagatccgctgcgacctggagcgacagaaccaggagtaccaggtgctcctggacgtgaaggcccggctggagggtgagatcaacacgtactggggcctgctggacagcgaggacagcaggcaagttccacagttactcatgaaatcccccagagtcacaaagaggctgatgtaaaagaatcctgtttccccaaagtctggacaagttcagacctccccagtgtgtttagggatcttcttaaaaaagtgctgaaaagtggctgaggttaagaacatgacactagagatatttttaaaatattctaaaggcagattaattattagtgtaacatttcatgctggcatctccctttgttcctgttttccactaaaggaaaatcaggaataggcctaagataacatttgcaaaatcaagaaaaaatataaaatactattcaactgccactgctacagtgaacatgaagtggcaattctgggtgcagagaagaaacaggcttcagtcaatgctattgtgcagagtttttttcagaacataatttgtagggcaaattttgacacggtttttctgagttgccattttatcaacattcccttgttaatcttggttgaaaatcgatttttccccaggctttcctgtagcccatgttcgaccacatgcacctcgagcaacacttgtgagccatgctcagcctatgtcatctgcactgttgaaaactgctgcttgtgaatgttaaggacagcaggtagaggaatcaaagccagcagcatcctagaaaggagatggggcttcaaccagggacatccaaaccggaagcacaaatccaggaggctctcatatcctggaattgccctccaggtatcctcagtctttctgctttactatttcctctccttccggcttatttgtggtatactggaagcccataaagcattcttgctcatctccaaataaaacgtgttttattcctttagcgtggtaaatatagctctatggctgattactgttgatagaatattcattttatggcaaggaaatcatctaaacccataaccatagtttcaatgtacataaacccaggctgaaaatattttttaactcctcaaatacaaataaattaatgaacccatgagaaatgtcatatatcttagaaaatagttgtgtgtatctttctgaggaaaaatattaggaataaaatatgataaaatgtattttttgattataaaagtactagattctctttttttaaatttggctcattaaaagggaaaaggtcacttatgatttcatcttccaaacagccatagtcaatattttggggtactttcttccagttttctttcttataatagatttttccacacagctataatcatactaacatatgcacacacttgtgtaaactttctttcatttatgtcatctaagcatttttaattctaataaaaacataagattgtattgtagccatcactttttttattttttattttttttttgagacagagtcttgctgtgtcacccaggctggagtgtagtcacactatctgggctcactgcaacctctgcctcctgggttcaagcgattctcctgcctcagcctcccaagtagctgggactacaggtgtctgccaccacaccaggctaatttttttttttttttagtagagacagggtttcaccgtgttagccaggatggtctcaatctcttgaccttgtgatccaccagcttcagcctcccaaagtgctgggattacaggtgtgagccactgcacccagcctgtagccatcattttactggttgcataatgtaccataaggtacattgatctgttattggacatttaggttataagaataattattctcatatatttaaaaaacaaggtagagaacttccagaatgatgtatatttccatattcctcctcctaaaaaccctggaaattacatatcaaataaacataagaggactctgaaaggtagaagaagaagccaaaccacctaaagatgttgagactccaggagtgacactgtggtgagctccctggattagctttttatctcatatatcccagagggggagctggagaaaccaacaaccagaaacaccaacaggtgcagacaaaacaaacaaacaaacaaacagaaagagcttgctctgcttaaagaaccagaaaagaggcagcctagaaaggcggaaaacctttagacaataaccactcaactcagccaaacaccacagaaaatatcatttcacccacccatatccacacaaggaaaggccaggtggggagtccagacttctatccttcccaggctgtaataaggcactcaaacttcaccactggggtggaatcagggaaggctaagtgagagatccaggactttcattcctactatgagacatggaagcactccctgtcccaccatcatggtatcagtggagaccacacgggaagcctggacttaactctacaggctgcagtgaggctcttcttttctcctctggggttagtgtcacaagagtcctactggacagtcagaactctttccctcctccagcagtaccaaggccacccccatgcagtgtcagtggaagctgcatgggagcaataacaagatattcctgcccctcctggccagggtggtatcagcagaggccaggtaaggagtctaaaatcctccctcccagcagtgatgaggggggctctccccttgggtgtcaataggggcaaagtggagagaacctgtatttctactcccacctggtaggaatgaagcagtgtcccccttcccctgccaaaacagtgtcagaggagacctgctagaacataagattaaacagtatcctgaatctcataacataatgccccaatgtccaggtttcaatcaacaattgctctttataccaaggatcataaaatctcaacttacaggaaaaaagatgatcaacaaattcaaacatcaagaggaaaaagacgttagaattaactgacaagggtttttaactttttatttgttatttttctgggtacatagatgtatatatttatggggtacatgagatgatttgacacaggcatgcaatgtgtaataatcacatggagaatggggtgtccatcccctcaagcatgtatctttggtgttacaaacatccagttacactattttacttattgacaatgatttttaaatagtcatcataaaaatgcttcagtaagcaatgcttcaataaactcttacaacaaatgcaaaaatagagaagactcaatgaagaagatggaaagactccagtggaaatttcagaactgaaacataccatagaaccaaaatagaaacctcaatggagatgggcttaacagcagaatgcaggccagagaggaaaacatcagggaatttgatgatacaataatagacatcatccgacctgaaaaacggaaaaaaaatagtgttaaaaagatagagtctcagggaattttggggctatatcaaacgatctaacattcatgtcagtggagttctgtaagggaggagaaaaagtgaagccaaaaacatttgaaggaataaacactgaaaatttacaaatatggcaaaagacaaaaacctacagattccagaaaccaagcaaaccccaaaaatgataaaccctaagaaatctacaccaggaaatatcatattcaaacttttgaaagctaaagacaaaaaaaattatgaaagcagtgagagagaaatgacaccttaccaatagaagaaaacaatttaattgatggcaggtatgtcaccataaaccatggaagccaatatgaagtaatacaatagttttcaaatgctaaaagaaaaaaaaaaactgtcggccaggcgtggtgactcacacctgtaatcccagcactttgggaggccaaggaggatggattacaaggtcaagagatcgagaccatcctggccaacatggtgaaaccccatctctactgaaaatacaaaaatttgctgggtgcggtggcgggcacctgtaatcccagctactcgggagactgaggcaggagaattgcttgaacccgggaggcggaggttgcagtgagcagagatcgtgccactgcactccagcctgggtgacagagcaagacaaaaaagaaaaaggaaggaagggagggagagagggagggagggaaggaaaggaaagagaaacaaagagagagagagaaagaaagaaagagaaagaagagaagagaaggaaggaaggaaagaaagaaggaaaaagaaaagagaaaagaaaagaagaaaagaaaggagggagggagggacggaacgaaggaaggagggagggagggaggaagggaaggaaggaaggaaaagaagaaggaaaggaaggaaggaatgaaggaagggagggagggaaggaaggaaggaaaagaagaaggaaaggaaggaaggaagaaagaaagaaagaaagaaagagagaaagaaactgtcaacccagatttatataccctttgaaaatatcgttcagaaaaccaaagagaaatcaagacattctcagatgaaggaaacttaaaagatgtggccagcaaaccaacctaaaacaatgactaaagaaaattccctaaacacaaacaaaactataaaataaggaaacttggaagatcagacaggaaaaaatataataaaaaattaatatatgattaatttaaataaatttctttctcctcctgagttttctaaattatgtttcatggttgaggcaagaagtataacactgtctgatgtggttctcaatatatgtgtagaaaatatttaagacaattatattaaaatggaggcgagtaaaggaatataaacaaaggcgagttttccacacttcacttaaactgataaaacgttaacactggtagactatggtaagctatgcatacagcatgaaatacccagagcaactatttaaaaagctatgccaataggtatactaaaaaacactatagataaatcaaaatggaactctaaagcatattcaagtaacccacagaaaggcaggaaaaagaatacagagaaacaaacaaaaaacagaatgaacaaacagaatacaataaatacaatacaggctaaatatagaaaattacagcaagtggaaagagtctaaagacatagaaaaaagacagatcttggcagagtggataaaaaagcatgatccaactgtacgatacattctgcaaaaagctaaatataacaatataggtaggttgaaagtaaaaggattgaagagatgcacaattgttcatagcagctttgtttgtaatagccaaaaactagagatcacagaaatgtcctaaagatctcaaggccatcatgccgagtgaaaaagggcaattcaaagggccatatatttgataattctatgtatataacattcttgaaatgacacaattataagaatggagaacaaattaggcataggacaaaggaaagctctgtggtgattgaatagttccatattttgattgcaccacccatgtgaagaaaacatatatgtggccaggtgcggtggcacacacctctaaccccagcactttgggaggctgaggcaggcagatcatgaggtcaggagtttgagaccagcctggccaacatggtgaaaccccgtctccactaaaaatacaaaaattaaccaggcatagtggtgcacgcatgtaatcccagctacttgggaggctgaggcaggagaattgcttgaacccaggaggtggaggttgcagtaagctgagatcgcgccactgcactccagcctgggcgacagagtgagactccgtctcaaaaaaaaaaaaaaaaaagtgcccacgattcagaaatctaatatttacaatattagatttaatattttaaatatttaatctatgtaaatttaatatttacaattcatggattcctcactggctctacagaggcagataaggccttcctatcactcagctactggtctcaggctggccccagtgcccattcttcctatgttgtgcacaacccctttctcagaaagacaggggcaaagctgtcaagagaactttctatcacttccagattcgatcttccaggcagtgtggacttgagtttttacagctgagattctccaaaatgacactcaaaaaaagaaaagagaagagagaagcacttctagaacagctgccttctcagtgcctggggcagggaagagacagcccaaagatcttgaaccagaaaacaaagccttggtaataccctgcctaactgcaaaggggcaagagagggtaagcctcccatgtgcccaaaaggagaggagaaccagatatgcgtgagcccgagtctcttccagaacagccttgaaacacacagatgaagaaaggtagagggaacccccacaataaatgtgcagtgggggaacagggcaggaagagcttggggaatagcaaaggatgcagttgggctagaatgtatagagtgggtcgggggtcctggaatatgagataaagtcagctgggtcaatattgtggagggtcttggttgccaggcaaacaagaatttgagccttgctctgtctgtaggaaggttgaacatttctgcaccagcaatggagctatatgaaggtagataaagaagatctccaaagtggagaatgtggtaaagtaatttacaggctagccagattgacaaaagttaacaaatgacctggtggtagaaaaataaagacaataagtacccactattctgtcaaaaggtttggtaatgaaaagaaggcagaagccaccttcatggaagaagtgcctcatggttacgggtcagacattgtaggatcagttaacagatgtgcttatagggaaagaaaaaatgatccagtagtaaagaagacatgaaagaggcaagaaaagggggagcataatggatgaaatgtggccctgaagaaatcaaaagggaatcagccaaggaaggaacaactctgcatgtgagacacaagaggaaaagaataaaaattattagaaaggtatggaggcagaaaaaaagtctaagaaactaacgaagcagaaacagttttgcagacaatttttctaatgattctaaaagagatacattcaatttgtggaatttgtggaataaaaacaagaaaataatattcatcagtaactataaaatgcaaagaatttcactgctaacctcttgatttatttactttcagtatttttcatacattttcaaactaatggactatttcaaacactgctattttatgaagtcaaatttatcgtattttttacaggttcttaatttcaagtcactgttacaaaggccttcctcatctgaatttgtaaaagtattctcctatattttattttagtacatttatgattttcacttttcacatttgaatctttgatccatttgtaatttaagtatatagataaagtagtgaacattcatgcagctgcacagttgtatcaaatcttaactttttatgttaactccactttattgagatacaattttcagacaataagatgcatcaattgaaagtgcgcaggtcaggctgggcacagtggctcacgcttgtaatcccagtgctttgggaggccaaggtgggaggatcagttgaggttaggagtttatgccagcctgggcaacataatgaggccccatctctaaaaaaatttttttaaattagccaggcatggtggcatgtgcctgtagtcccagctacttgggaagctgaggtgggaagacaacttgagcccagtaattcaaggcttcagtgagctatgatcatgctactaaactccagcctgggcaatagagtgagaccctgtgtctaaaaataaaaataaaagtaggcagcttcatggagtttgaaagcacatgaatttgtgtaatcaacacccagatcaagatacagaatagcatttcaaaatgtagaacatcaaccttagaaattctttcttgttgctttccagccagtacatctctctgacagagacaaccactactcttatctctaaccatgtcaaagatgagttttgcctgttcttgaagttaatataaatgtagtcatactgttcgtactgttttgtgcctgacttcttcagctcaatatgtttttgagatttttccatggtgtcatgagtaccggcagttcattctttattgttgttgcatactactccattacataaacatgtcacagtttgttgtccattattctgtttatgagcagttatttttattttagtgctattaagaatatagctgctataagcattcttgtgcaaatattattgtgtgtataaaatatatacattcatctctcttggacatatacctaaccatgaaattgctaggtccttgggggaggtcctttgtcagagagagagagagagagagagagagatagtatattactgtataaataaatatgtgtttatttatttttatacacatatttatttatagagtcatgtgccacataatgacatttcagtcaacaatgatggaacatacacatacaaaagctgtcccaaaaaactataatgtcatatttttattgtaccttttctatgtttaaatgtgtttccagataacaaatacttaccattgtgttacagttgcctactgtattcagtacagtaacatgctgtgcaggtttacagcctatgagcaatagactataccatatagcctaagtgtgttataggctataccatccaggttcatgaagtccactgtgatgtttacacaacaacaaaatcactaaaggtgaatttctcagaatatattcccattgttacaaaagatatgacgttgtgtatgtatgtgttctaatgtgtgcgttggggggtgggtgtatgaagagagagagagaatattttaacccaggctgtagcttgccttttcactttcttagctatttatctgatcaacaaaaggttttcattttgatgaagtctaatctatttattatagtgtcctccatgagcttagaagtcttctcatggcagaaggttatgaatataatcttctgagttttcttctaaaaactttagacttgaaatcttcacaattaagtgtttaatccaacctgaattaagttttatacgtagcgtgaggtagagatcaagatgtattcattttggctatacaagtatccacttgattcagcgacaagtattgaacagtattgaaaaaacagtattgaaaaagctttccttttctcattgacttgctttgggatctttgtcagaaatcaattgaccacatatatgtgagtctatttctaaactctatattctttctcattgatctactttccaacccttatgccaatatcacactgttttaattgtagtagcattatagtaacttgcatgaatttacatttcattgccacaagcaatgagagtgctataggcagtgaatgtatctgttatcaaactttgatttttttcagtttgataggtggaaaactaaaatatctcagtataatttaaatttacatttctcttttcatgagtgacattgagcattttttcttattttaagtgccttttgtattttccttttggtcactgtctagagtgtaattgtaatattgtttcccagtttgtcatcttgtcttctggttttacaggttgtatttttcacccaagcacaagttcaaacactgttattttatggagtcaaatctaacagttttttacggcttcttaattttgagtcatcattggaaaagtcttctgactccaaatttataaaataattatccttttgggcatatttattatttatttttcatatctcaatctttgatctacttgtaattcgtcccactgtaaaggatgaagtatggtttcaacattccctgcccccacaccaaagggaatacaaaattgtccccaaagtacatataatacatataacggtctaccttttccccatggcttttattttgtattttattttattttattaaaaatgaaatcgcactgtgttgcccacctgaacttgaactcctgggttcaagtaattcttctgcctcagcctcctacagaatgggagaaaatttttgcaatctgtccatctgacaaagggctaatatacagaatctacaaggaacttaaacaaatttacaagaaaaaacaaacaaccccatcaaaaaaatgggctaaggatatagaaagacacttctcaaaagaagacatttatgtggccaacaaacatatgaaaaaagctcatcatcactggtcactagagaaatgcaaatcaaaccacaatgagataccatctcacaccagttagaatgacaatcattaaaaagtcaggaaacaacagatgctggagaggatggagagaaattggaacacttttacacagttggtgggagtgtaaattagttcaaccaatgcagaagacagtgtggcaatttcttaaggatcaagaaccataaatacagtttgacccagcaatcctattacttgatacatacccaaaggattataaatcattctactataaagacacatgcacatgtatgtttattgcagcactattcacaatagcaaagacatggaaccaacccaaatgcccatcaatgatggactggataaagaaaatgtggcacatatacaccatggaatactatacagccataataaaggattagttcatgtcctttgcagggacatgaataaagctggaaaccatcattctcagcaaactcacacaggaacagaaaaccaaacactgcatgttctcactcataagtgggagttgaacaatgagcacacatggacacagggaggggaacatcacaccggggactgtgagggggtgaggggctaggggtgggatagcattaggagaaatacctaatgtagatgacaggttgatgggtacagcaaaccaccatggcacttgtatacctatgtagcaaacctgcacgttctgcacatgtatcccagaactcaaagtacaaaaaatctcataattcaagaaaaaaaaaaaaggatgaaaaggggccactagctgaggatgtggacagcctgtagaagctggaaaaggcaagaaaatgatgttcccctagagcctccataaaggattagcagcaagtaactttctgaagaaaatgctgagtaagtattcctcagaaagaaaacacacccctttcaatgaatcctatttaaacatccagtataaaccaacactgtgatacatttttatctaatgtaataccacaagcaaacaccaagcactaaaaatgttataaaatgtggactttggaaaaccaaaagagagctagtctcttttccaagaaatttcttattagcaatcaaaccctaccttttccccatggcttttattttatttcatattttatttatattttattttatgttattacattttatggaaagctaaaacataaatctagcaattatctttaaaacaagacttttaaaagactaacattttaattcatactcacattgtcctgacactgaaaatggggaaaccatttgggcagaacaaactaaaatattgacttctgatttctaagtttaccaataattattaaacattaatagtttcccttttctagagaagaaaggaaaagaaggatgaactcattcctggttaagctcagtgccaagtggagaggtcaacaagaatgtaatgaacttagtatactcacacctgcttaataatggatgctgttaggacagttccttttgaagacataatttgaagctctgggtccaatagacaagtagtagttatgatgggtaataacttactaacagcctaaatgcacatgtttatgagacaaataactcttcttaagcaagtaaaaagcagactaataagatgttcctacaggatttgatataaacctgagaaaggaaaacatcccacctgtgtgacaccacgtagaagagaggctatataagcacttcaaagaggaaaacaccaagagccttggaattcagactctgtggaggtggcttgagcttttcatcctggtgaccacagacctggaacaaactaaagccagacacatactatggacaccaagggctgtacaacaaccaattctccttcaaccccatgtcaaaactgctctaggattacaaatgttagtaccatctcttctaacaacggctgccatcctggtggccttacagtcaacaactgtcaaccagctggccacgttctcagaattccctgggaccagggctgccaacccactcctcgcttttgtcgcaagcccatctacctaatgaacaacttcaatgcccgtttttctctggatgactgcagctggtatggtgaaggcatcaacagtaatgagaaggagaccatgcaaatcttgaacgagcgccttgctaactacctgcaaaaggtgcgaatgctagaacgagagaatgctgaactggaatctaaaatccaggaagaaagtaacaaagagctccctgttctatgtcctgattacctgtcttactacactaccattgaggagctccagcagaaggtaagattcctaagaacctgtttaatcgtgttgtgaattaatggtttccaagcaacagttatttgctaaactttaatattttttgttcagttgatgctgaaaatttttttgaagaatagaaaaatttcttgagtgaaattgtcatcttgaggcagcattcagagtctgatagtatttctggtcaggcgcagtgatgcacacctgtaatcctaacactttgggaggctgaggcagacagatcacttgagcccaggagttctagaccatcctgggcaacatgatgaaattccatccttacacacacacacacacacacacacatacacacacaaaaaaaaattagatgggcgtggtggcacatgcctgtggtcccagctacttgggaggctgaggtgggaggatcacttgagcccaagaggttgaggctgccatgagccaagatcctgccactgcactccagcccagacaaaagtgagactatgtctttaaaaatcagaaacaaaaagaagagtctcatggtgtttcctttctccagaaatacactctaccattataactagatgactcaggaccaaaagatgttaacagcaagttgttgccattttttaaataaaaatagggaaacagagatcagagaaaataaattttgctttaatgagtttctaagcaatttagtttttatccatttttcaaccatcaccacctttttctccttttatgcttatgttatcatctccacattgcttggtttgtttctacaccaaacctaagtttgttatgcacagacgtattctgctactacatatctggatttattcagttttattcattcaacaaatgtttactgagcagcaacaacattgggccaaacattgttctagattctgggaaaatattggtgacctttaaaaagtccctgccctcatggagttgacattctagtggatcatggtatttatataaatttaggatggattttattttattttttatttatttatttatgtatttattgagatggagtctcactctgtcaccaggctggagtgcaatggcgcgatctctgctcactgcaacctccagctcccaggttcaagcgattctccctcctctgcctctctagtagctgggtctacaggcacgcaccaccacacccagataatttttgtatttttttttttttttgagacggagtctcgctctgtctcccaggctgcagtgcagtggcgcgatctcggctcactgctagctccgcttcctgggttcatgccattctcctgcctcagcctcccaagtagctgggactacaggcgcccgccaccacgcccagctaattttttttttttttatatttttagtagagacggggtttcaccgtgttagccaggatggtcttgatctcctgacctcgtgatctacccgcctcggcctcccaaagtgctgggattacaggcgtgagccactgcgcccggccaatttttgtattttttagtagagacagggtttcaccatgttggccaggatggtcttgatctcttgacctcgtgatccgcccgcctcagcctcccaagtgctgatattacatgggtgagccactgctctcagcctggattttttaacaacaacaacaaaaaaaatacttaaaagtttctagttaagtactttttgctgatcttttaggaaaataacaggaaatctgactttctgaagttttccaagctttgtgagcatagctatgaagattaataaaaagtctacttagccttcccctgttacttgacacacacacaaaccccttggttcttaaagaaggaaatcttggtgtttgcttcatttgtgtgtacaatctcttaattctagatcttgtgtaccaaggccgagaattccagactggtctcgcaaattgacaacaccaaactgactgcagatgacttgagagccaagtaagcccacccaacaccgtcatcaatgacagagctcaccctgagtctgaccgagatgccctcaacaaaattgtccccatgtctactaaccctcttgccccagatgatgttggcacaagcccagaaaagactttcaaattcaatgaatgattaagattaataactgctcacatgtatacagtacctatagtttctaacttgtgaacccatttgattacctacacaatagttcagtaaaatagataggactaatatattgttactctctttaaggtgagaaatctgtggcttagtgaggctaagttactcacccaaaggtaagcataactagcacaagtcaaaaccgaaacttggacacatgttttctgagccctaatccagtgctttcttcacttacattgcattgccactaggggcagaggaaggacaataaattcccatatctcaaagaacagcaatgtagatccccctagcaaactaatttgggaataataattaagttatgatctatatcaaatggtttcacctccaaagagaataaaacttctaatagaaatacactaagtgaggtgcccagagcaaaatgcagatgagagttctgcttggcttggtttgcatcatctcctttcagatgtctctcttttcccatctggtttttaaagatacgaagctgaggtgtctctacgccagctggtagagtcagatgccaatggcctcaagcagatcctgaatgtgctgaccctgggcaaggccgacctagaggcacaagtccagtctctgaaagaggagctcctttgcctcaagaacaaccacaaagaggtgagacaaagaccaatagagtaatcacaagctaagtccctaaaagtagcatcagttcctttgagttgcacctgacaaagggtgtgcccgcttgtattagttcgttctcacactgctataaagaaataactgagagtaggtaatttataaaggacagaagtgtaactgagtcacagttccacatggctggggaggcctcaggaaacttacaatcatggcttaaggggaagcaggcacatctcacttggcagcaggagacagagagagaccaaagggggaagagccctttataaaactatcagatcttgtgagaactcactcactatcctaagaacagcatgggggacaccacccccatgatccaatctcctcccactaggtccctcccttgacacatgggaattatgggaattacaattcgagatgagatttgggtggggacacagagccaaaccactgctacgtactactctggtttagccctgaaaatacctactgctactagcactggttcaaggtagtatttcaaatccactggctccaacacaatatctggagccataaggggaagaaaggcctccaacatcccctccagcttttctacaagaaggaacccaatttttctgtccttacagtcttcccatgtttgtaggcatccctatacaggcttctgccacctcccattggtacaagtcaatattggtgcaagtcaatattggcacaatcccgtatttgcaccatagagactataatctctcatgatcaattccacctttatcctgtttcacccattatccagccctggaaatgatctaaattttttggaactctggtcttgctactcatttttttttaattttgcacacatttaaacacacagtcctacctgaaagagtcttaaatcattttatagcatctcaataacacctgtaaatcatgtattcctttgttgtgggctatattttagacacaattaagctaaatcgtagcagttagagtgaaacaagaacacaaaggggttatctgttcaccaagtgacttcacagtctttttctttccttaggaaatcaattctttacagtgtcagcttggggagagacttgacattgaagtgactgctgccccttctgctgacctaaaccaggttctacaagaaatgagatgtcaatatgagcccatcatggagacaaaccgcaaagatgtggaacagtggttcaacacgcaggtgggggatatagaaaagtcaaaaacaataagctgatgctgcatttctagggccctttaatcaaagtcatgttttcctcccataatattctcagtctctggctgtgtgtttcagatagaggagctgaatcaacaagtggtgaccagctctcaacagcagcaatgctgccaaaaggagatcatagaactgagacgcagtgtgaacactctggaggttgaactgcaggcccagcatcgaatggtactgagcaagctgaccaagcctagctcagcaaagatggaaacagtcccttacacctgtgtgctgcagtatttcccaaactgtgtctttcagaacaatagttcctcatttgttaaagcgtctatggctgaaaaagagctttgtggccaaataagtctacgaaacgctgcactaaaccaaggttaaacagggtgccttcctgtgagccattaataagctaatatacaccatgaatctccaggaagggggtatatggtattcagcattccaaaacttatttgactgtggatccccccactttttttagaacatctcatggtattaatgattcatgaagtacactttgggaaacactgggagagcattttattatatgcaaagcatttttacaagctatcacatgagatttataaagcaatcctaagagggggggtggcataattattaacgaatgttacagatgaggctccaagagctaaagtgattttcccaagcaaatccaaggtaagtttcagcccacctattttatagagacactgagatcctgagacattaagaaactcatccaaagtcacaaaagaaataagagtctgagccagagtttagattccaaagccagtatcattctgtctcatgataatgcctctctgaagtagagaattgcttacatgctctgatgtgaaggcttttgggaagaccttgccccacactggttttgtcaccagctagtcatgtgaccttggacaacatattgaaccacttgaacctcagttttctcatctataaaaattgggataatcatgcaaataataggctattaaaacctaaaatcccatcattatccatagacttacagaatgatagagcaggaatgaaatttactcatcagtttcaactttcatattttacatataaaggaattgatctggtggataaattgtatatggtaaaacattgcttccttccttttttaagacacgaacactcactgaatgaagtgccatggtaatgcttttttttttttttctttttgagatggagtctcactctgtcgcccagactggacagcagtggcacgatctcgggtcactgcaacctccacctcccgggttcaagcaattctctgccttagcctcccaagtagctgggattacaggtgcccaccagaacacccagctaattttttgtatttttagtagagacggggtttcaccatcttggccaggctggtcttgaactcctgaccttgtgatccacccacctgggcctcccaaagtgctgggattataggcgtgagccactgcgcccagccagtaatgcatttttaatgcctgggtgtgcattaagttattattttttctctcctaagtaggaaagtgtggtgcgagactattggttggtcaagaaagagaaagtgaaacaaatacttacagagaagcaaaaagagaaagagagaaagagggaagagataaaggaaagcagattttagcatagttgatcatttgggttttggatttatttgattaggaaacaataaataaagtgcttggagatctatcagtagtgtcacaaagaaaccattttttttaaatgatacaggtcacaggtgacctgggcttaaaggagtcattataaatcctactatccttctccatggtagagagattcccaagagtgcatcctaacggagacagaggctcgctacacggccttgctgacccagatccagagtctgattgataacctggaagctcagctggcagagatccggtgtgccctggaaagacagaaccaagaatacgagatcctgctggacgtcaagtcccggctggaatgtgagattaccacataccgcagccttctggagagctcggatggcaagtatgtaaaataacagcaacttctatgacaaaaaagtgtaaatgaacgcagatatatgtactgccactggcaacaggggtcaagtgctttgtttgaccttcttgccagtgatggggagcttggacagaggcatccacacaccctctcaagctgtgccatgaggaagacttgcaattgtaaccttatccaaatttgaggcattggctgacctgagctgttctgaagagcccatgggccaggttaatttcttataggttgcttaccttcttagagttttaaaaattactagagaaaaaattatttccccatagatgaatattcctggtgaccattacagatgtttccccactgagatgaacgtctgattttcatgagcttgtacaaaacaacccaggctcctttggaggaacattctgctcaggctgaaacccctaaccctatctagccactagtccttgaggccaacagaagcatgtacacatgtatgttttagcatcttttttaaaaaataaaagttataatttttgtaagcaataagaagctaaccaacccataagtaaacatatatggaggatgagttctttgaagcaactcagtccaaactaaaaccccagagacttagttacaattgcaaaggagacctacttcccgaaaataatcagtgaactcttcacagcattcttttaattggcatgaccacattatgtgagcacaatggtcatcaatgctgtcacctttaggagctgtgatcatataccaaaatacctcgaatcatcaaagaaagattatgtttataaaaagagtgtttactatgaactgctttttacttcagttctctaaaaactatgcatagacagccagaaggcactttgaagcttcctgatgacacagtgaggactctttcatagctggggttcaggccaccactattagtatgactaactcctcaatgagaaaaatatctggttaatttccattcctcggataataatgccctcaacttgttccttatcactgttgatcctgtgggtttagtttccattatatccattctgcagatgaaaaactaaaggttgagtgcgttaaatgacttagctgaggtcaccagctggtaaaggacagagctggtctctgcctcagtcttttgactgctagtgcagtattctttccacaatgtgatggtattgactaatggaaacttacataatcgaatacttctaaacctaggatgctgatttccaatggatttaatctgattctttttcttccagtaactacagtacaaaataaatgaataagcatttagaagtatgtacttgtcttgagcaacacgtgttaaaaaaattagccacaatcatttttctccatgaccatcatcgccttccctcaatcacagctaaaattgtgttttttttccttaggcgtccctgttacccacgtgccaccaaatgtgagccttccccttggacatcttgtaagtccggagccatagaaagcacggccccagcttgcacatcctcatccccctgcagcttaaaggagcactgcagtgcctgcggacccctgtcccggatactggttaaaatttgcaccatcaccaaggagattaaggatgggaaggtcatttcttcttacgagcatgtgcagccttgtttcatcatcagacctgccaaagtctaacatcccaaggtgatgaaaatgacccacatttatgaaacagaggccaatacatgctcctgccagagaggtttaagaaaactccccagtcccttaaggtacttagtttcttactactacagcgggtccccattgctaggtagaatatcttttattctgctccttccctaactcaccactgctaacatgataataaattacatttctctggaaggatgttttgcatttatctgagggatgggaactgatttgtaagcacccaggaagatggcctacattgcttgactacccaggtgattgatgggcaggtctctctcttgtttactcaggccttgtttaccgacattcctccttagagccagtcagacaagtttagggttgtttttggccaccggcacctgaaggtgaaaagctacaaccttcccttctaaatgtctttggatacagaaagaaacatatatgggaacagtataaataggggaaaagatctttaatatttaattcacttgtgtagatagtcacgagtatggatcctattaaactctgctgtcttaattatgatttatctatactaacatactttacctttccaaagatatttttttaaatgtccatggtctccaaaactttgtgacctattaggctctccaaatattttatttgagaatcagataagttgtggggagtgaatctagaacactttgaagaaatagcatgggtcttttcattaaacatttgctatttctctttctattctttagggaatgggagtttgttctgattgtttgacaaggaacatttagctggaattctcaagaaataacccttcttcccctccctgtgaagagtgacaaagaaaaacatagcttagattcctgcttcaatctatccatcagagtaaatggacataatatccacacattttgcagaaaagcaatagtgaataattgctgcttgtaagtgcaaggcagtcccaatgtgagaaggcatcatttatataccagccatcatcacagcttcttacaggatagtctcagaatatgtaagtcattcctgacaataatcattggacattgccagaggttttaagaaataattcaaaatcaaacacagatgggtagtcaaaaggcctgaagtcctacacctgcatttcccagctgtgaccttggggaaaacatttagacttcatcaaatttaatttctgtgtttgttaaatgaggatcatgcctacttcacagggttgttgtgatgatcaaatgaaattgtttatgtgacactgctttgaatgctgaaaagcaccacccaatgtaatttttatgtaagttttgcttttagctacagccctagacctatttttgtaattatctcattttaaaattctttcttcatgaatttagttatccagtcatgattttggagttttaatagtgtttaacttttaggagaaaaaaaaacatgatttcctgtgatcaggcccacaattctactcaataaagcatttttcagttcttagggtatgtatcgcatatcaatgagtcaataatgcctgatgcccacatcaaagacacatgcattgtgtaacttacagcttgatgatttacttcctccagacaagtagcaacttacactaggcaagtggaatgcagaactcccagaatgacctcttttaaatcaataatttctctctcatctgagtgggcagagtacctccggtcagtagttaactgcgtactatctcaggctgcaggatgaaaatgtggaaagagcatggaactgggattcagaaaccttgggacggagtctcaatccagcctgggcatgtatgacctcgagtaaataggatataacaatataagccctgcctaccacacggctgcaaggataaaatggaataataatggtgaaagggtctcataaactgtaaggtgctttgcagaagggcattcctattccctatatttaaacctagacacatgtcgtttccatcaataccttcttcctttctttctggttcagtgctgggcccaggtggaccttgatatatatcatccacactaaaatctgctccgagctacaaaattagggttgaggaatctcactggactcaagctaagattgaactgatgcagcagtgccattttcagtttatcctagaagtaggatgccttcctcctatggagagcaaaatatcccccatgccattcatggttttaaaaaatatatgattataagctgcacagtaaagaggggagttagccactcgaaggcttgcagttttgtttttttttttaagtgtcttcttcgtataagagaatgtaaaaccatttgctggttgtatgcatgtggtcaaaacttttaaaggcaataaggagactggatttttactaggaggctaaataagtatcctacacagccacaggaggaaatttaaggttttatgacagttcagcataagtcagcagctagagcagaaaaggggctcgtggggagggaaagtgtaattttagcacagttcgaaagacaaccatgaatcaggaaacacagcatggtgtccagagcctgaggtcaaatcctatatctctgcttctcactctgagggtccataattatatttcttaaaaagggagatattttagatatattttttctagatttttttcctttcttcttgttgactccacttcatgtcatagctagtttaaactcttccaaacacagaggtaagtaaccacgcttccccctttctccttgcctctcaccccttaactgtcccccatcacctgcccccatcacacagcccacaccctttgcatccttacttcccagagccaattccagcaattgctgatcagaagagactacccagaaacttttcctccagagttcagttagtggtaaccccttacctgacgtcccgccaaaacttctccagtgtgacccagaagccacctgcaattgcattaataggggagtctgtatcattcagattcctgggccttaccccagacctcctgtatctgcatctccagctgtgggacctgggaatccaaattttaacaaaagtctcagctgaagtgtgtgcactgaattaaaagccactgctttatcactgatgggggcttttggcttaaagatctgaatgacttgatgacttatttgaggcttttagatttgggcatagcttgatagacaaccacacatgcagattcccccctccttcgtgtctattcgcctgtttataaaatggagttaatcaataatgaccaataatttaataaatatcatcaactcatttaatcctcacaaccccatcatgaagtagatattattaatagccccatttcacagatgaggaaactgctgggcagaaaatttaactgactcatccatgccgcacaataatgggattgaattatcagtacttttatttccttagaaaggtcaaatagcacctgatacaagaacagaaataatctgtagtagcaacagcttgcttttcaactcttcaaagcacccttctccagctcatcacagcttccagtgagaatcatccaaggagtctttatccctcatccagaaatgcagagaatatgtggatttttgaatgcggaaggtattggatggcagctaatagcatttttaatgtgagagatggagaatctggggcacagaaagaacagtaactggtccatggtacgtgggtcgaaaagaggaccagtgctctttcttctgctcctcactctccttgttccccgtcttctgctcctcactctcctcgttcccaggcacatctgtagtgaacaggtgtggactgaggcctaatgtgaagaacactggaccccaagacagtgacctcaggctctaactctcagaagtaccatttggcttctctgtgcttagactctgggcagtcaccatggactcttcaaagcttacgtccttagtttctcttacaagctctgacattacttatcatgtctagctttctacctctgtaaataagaactgacaccaaaaaaagtcttccaaccccccccaccccactttgccagtgtcttttaaaggcaattggatggtatcagtgagatcttcatgtctttagaagataatgactctatgttgttattaattcccataatttccatttttcaaacaatgaagaaaagtatcttactctagacagaaacggatcccttacctgagtaagtttatcctatttctgtccattttgatttaaaattaaagtttttataatgaaaacacattttaaaagcaaacatccactttaaatgagagaaggggggaaacattaaaattcaagagaaaaggaaagtgtccccaaagagaagagaataggtcattattaggttaggaagaatttctaggctgaggcaatcagcatccgtgacacagacttgggttagtctcagggcaagcaaaccttgaatacattgtttcaacactgtgatcaaatgtcttttataggaaatgaatcctctgggtattgggctggctagaaatatctgatcagtgtgttcatgaatgattcacaagtttcatgggaacaacccacgcacccagttcaaatgggaacaaccctgtttggcaacattgaaaggtttgctgtaattatcctttcaggttaaacatcatatttggagagctttcctaggtgatgcttttgagccacaggctaccacttacatgcacatgggaaaaaatgtatatcaatgtttctaaacatcttaagaaggcatcacaatagcaaaatttctgaatatgttttcttgatcctctctctctctctctctctctctctctttctctctctcaccccccccccctctttctctctctctggaacaacccaatagtcaaggcggacatactagtcgtacctggagaaaacatctcagacagtaagatctcttacttttttcaggaggagagcaagtttgggactcctttctctttttccttctccaaaaacaaacaaacaaaaaaaacagaaacaaaaaagaatcaaaaaggcctttctgctaatccagaagcaaaaatttccgatattacagctcgttatggagggccactgggcacgctagtgctcaagagtttcctggaaagggttgtatccacccatttggtatctgtggcccttaaagaaactgcctaactctactgacccagaagacctagagagagaccatgctttgggctgaacatctctaaacatgggtagctggtcataaagaactacccatcaactgtatgtaagagtaaaaaggtcttctctctgcacttctgtggaggataaatgtctgtcagctcattttccattgaccggaaaaaaataactgtgttctcttccttcactgccactttctaagaaacacccccttccccactcccagcatagactctggttgcagggagaagtctcacagtggaaggtaaataaaattactacccatgtaagaggactctgttaagttcagtggggaaaggagactaggatgaaatctcagaacaagcacccttttaaaggtattagaaaaacctagaaaagaactttggccacctttgtttaaaaagcagaatcatgtactgattaataacacatacttgaatctagaccagctgggtctctgattcccagccctgccacataccatgagatcttgggcaagttacttaatctctctatttcctcatctttaaaatggggctattaatagcatctacttcatagggctgagatgacatcattaattaatgcatgcaaagctcctagagcatgcctggcacccagtaaccttgttagtaggattgcattatactgcttcgtgaagcttacttcagttggcaaaacaatcacatgagagctaatgaattatttcacttgagccaaatgacaatggcatagtcatgcaaagccattctgataactaatgaaagtgctatattaaggatagaacctttctttttaaaagaaagctgagtcacacctgacccaaagtaaaaaccacataaaggtccaactcttctgttttccagaatgttagggagctcagttgtaaaggacctctccatcatgtatcaaccttcacaatctttgcggccagtaggaagaagatagccctggaggagaagggagaacagtttgaagtcatccctgtaacaggatcacttttgtggacaactgaaatgacagggcaattcagagaggactgatggcccttctcctagtacaatatctgttacccttgtctcttgtggccctgatgtttcctggagtcaggttatggtgtcaatggagaaaacagctggaaggcttctccaccgccaacacataataaaagtaatcacagatgcacagaagccacagtgtctcctagggccaaaaagtagaaagagtaatgcttctttcattcaattaaaaactgattaaatattatgcctctagacattgtgctacatgctttacatgaattatctcactcaattctcacaatggccctaccatactatggttattaccacattactaacaagtgaactaaggcttacagaagttaagtaatttgctcagtgtcacagctagtaaatgttaaagtcaaaatctgaacaaactcaaatcctctattccaaatgcccaatcaattaaataattactcaagtttgaaaatgtcatacatgtagcctaatgaaagctataaagaattaaagaaataatgcttgtcttggaggtctaaagaaggtgagccatatccctggtggttcaagtggttaagaaaatattttaaaaagagaaagtgagccctaaaaacacaacacaacagtgtccagcccaatccaggaaggggcaacactgaactcatgaacaccatctaagcacgtgtggacttgaggcagtttttcaacctcattcctcaagaccccatatccctcttctagttccatttttgacaaaagccttcatattacaatttggtttctctaattcttaggtacaacaaagaaggtgcattgatttgcagttgggaactctgtggttgcaaaatggatcatctttcaatgttaaattaataagtttgcattctgtctctttcatctggcacttaaaagtcaggttactctgagtcagctcctgagaatccctttggttctggtgcactaataacccaccagcctaagaacagacatagaccactgtgacttcacaagaaagtatcaccttgtgaagttctgctttggagaccagatgacctaactcaacagcatcttcatctcttctcattctaaccacaacaattaggctgttggatttgtgtgaagtttattgctagaagattggcacagtatagccctgctctactagatataaagccaagaggtcttgaatggagaagcattgggaaagtgtaggtctcatttctaactagttcatattcatggcgagcataggctcaaaacaatgaatgccggatattcatgtttccaacaatttgtggcttcatcagcaattgtgggctgccaaagctgcaggggacttcctggttttgacccatcccaagagtaacaggacacaaggctgataggatgaaatatccaaagtccacccccaggattccattttttttctttttttttttttgagacagagttttgctcgtgttgcccaggctggagtgcaatggcacgatctcggctcaccgcaacctccacctcctgggttcaagtgattctcctgccttggcctcccaagtagctaggattacaggcatgcgccaccatgcccagacaattgtggtttttttttttttttttagtagagacagagtttctccacgttggtcaggctggtctcgaactcctgacctcagatgatccacctgccttggcctcccaaagtgctgggattacaggtgtgagcaaccacacccactgcccccccccacccccacagggtcccttttaagaaaggctacaaattataattagagggatggtaatcagaaatgaaatcaaacgtgttgggttcagaaaaaaacagaagatgctatattagtgtattcaggagaggcactgggagaaatagacaaaataagaaagagaaaggagcaaaatggatatgtttttgtggctgcagagtaagaagaaccaagaggtcatttggagctcacttacatggaacagaatgtacagtgggactaagattgcagggaccgtgtccagcgtcccagttacagcaccgtctctttgtagtaatgacacaaagactatgtagtaaataataattaaggatgaaagacgagctgtggacaaagggtgagatcaggagggaaataggctttggttgtaaataaaagacacatattcacatttgccctaatgatggttcccacgtgccgtggatcttcaggaacagccttccttttatgtaattttatgcttctccgtaaaaattatttgtaaaatgtttaattaaatgtgatttaaattctataattttctgaggtatatcatatatattaatttgaaaatttaaaaatccacctataatttgcctttttagggtttatgaaatatagtaactataaccatctttgctgttacgctaataattaaagatctagactaagtatgtgtatggaaaatatgttttataaatcacatggaaaacacattctattcaccttgatttaatctttgtaggagattggtcagagtggtgggagaaactatagggaaaggatgcaaaccttctgaaagttcagaaggctctgcatagcttcaggggagaataagctgaaggcagctgttctctgatcctgaggcagagggcaaggagtaggtacaaggaggtgtaggggaatttatcgtaaacaggcttgtttacttaggttgtccagaaaccgacctttgataatctgtgcacatgactgctccctgaaaaggggaacaataatgttaattacccgcagattgtgtttgctccaggctttcggcattatgtctgtactgaataaaagcaagcagcttcagctgttcgcagctgctctcttctttggccctaagtgccggcagacccctagctgctcttacactgcacgcctgtgttgtcagtactcccttcatccgacgctcggccagggtctgcaggacagacctggcaaatcttcagcaaaaatccatcaccagagttcctactggatgtttcccccacaaacacacagacactacgatgttctactgccactgtaacaaagtgacatgcatttcatggctcaaaataacacaaaacacgaatgtactatcttactgttctctatttcagaaatctgacttgggactcagtgtactaaaatcaaagtgttggaggtcctgggggggatttgttttattgccaaacttttccagctttcagaggctgctcacattcctgggcttgtccaccatttccatcttcaccatcagccatctcgtcacccttaactctgccttcatcacatctccttcgccaacactgactgaatcttctacttccctcttccacctttttttttttttttttgagacggagtcttgctctgtcacccaggctggagtgcagtgacgcgatcttggctcactgcaacctccacctcccaggttcaagccattctcctgcctcagcctccggagtagctgggattacaggtgtgcaggcatgcaggcatgcaggcatgtgccaccatgcccagctaatttttgtggggttttttgtttgtttgtttgttcgttcgtttagtagagacagggtttcaccatgttggtcaggctggtctcgaacccttgacctcgtgatccacccacctcggcctcctaaagtgctgagattacaagcgtgagccaccgtgcccagcccctcttccacttttaaagacattatgattatcttgggcccacctgaataattcaggatactctccctattttaaggccagctgattagcaaccttaattctacttgtgactttaattacctttttgccaagtaacatcagctattcacaggctctgggtattaggacctgggcatccttcggggaccattattcttcctcccacaccaaaggaaacagagagagggaggggaaaagagacagcccatgtattatctctctaaaaccccaaaaccaaaactggagtaagcaataaagtcacgagtgtttaaattcacgaaccaatcaagcttcccggttgtacttcaaccctcagggaacattctgacataaggagagcatatgtttaaggctatatcttaactaatagtttgaagatgtaaacatactccataaccttgtggggtcatctctttagagcaacaataataacaattaacatttactgagtgcttccaatgtgccaaagtgttaagtgttctctatgtgcatttgctatacaactacccattttgcagatgaagaaagtgaggcacgagaggttcacagccagtcacacagatagttagtgccacagccaggattcacacccaggaccatgggactccaaatcctgcacttttaaccgtcatgaaaaactgcctcttcctcctttttttttttaaccaatatacactttgcaataatttattccctaattgacagagctagaaggaaaagaccagagtgggacctaaccaaaggcatttggaaatggcttttacctgtatttggaaactcaagccttcctagggaagaactatgagttcactgctccactctaccttaaaccccagttattataacacgatgtgaactttccatatgttacattgttcacatcaagttataataactggggcttaaggtagagtggagcagtgaacttatagttcactgctagggtggaaagagtgcctgccctaaaataactttaaacagataacatgataatagtaagaataaaatatagcaaaacaaaaaattggggattatgtttaggatataatttatatagaaaagtgagattttaaaagccacaaagcatattaaaataaattctgtaagtttagaacactctataaaaatatatatgacttctcagcaaaagtatccaaaaccagaacatagatataggcttatttcacctagctaaaatagagtattctaacacactcacacatacacacacaaacacacacagacacattttcataatagtatcactgagtactttttaatgtataatgcatagattatctcctttcgtttccacaacaaccccatcaatcagggctgagtattaatctcagttcacagctgtggaaattaaagactgaagaactgggtagcaatggcagaattgggatgtgaactgacagctggtaaccagggtattcatcagcataaatctagactgagctttacatggactaagtttataaaatgtaaactcctgaagttcctgtttctccttaagttcacctggggacagaattatagcttttaggctagactttttcatctagcccttgtgacttcctgacaacttcatcggtctcccctctgtccagacttgtgggatcctgacttcagggtggaatacgggtgttttttaatcattctcctcctctgccctcatctctgcacagcagtctacagattacaaagcttgtatgtgtaccctacagacctattacatagcttctgtatgtatattacatacagattacatgtatcatgtgtgtacattgcttgaaaattacatagttcaagtatgtttgttacataccaattatgtggctcatgtatgtaaagtacacacctattacatagctaatgtatatatattacatgtagatcacaaagcttatgtatgtacattaactcacttgctccccacaacaaccctctaaactacaaggaaaattattggcagtctcattttcatggtaagaactttgagaccagagaggttaatgttgctaggtgggtgggttaacggtagagcgtggactttaaacccctagcccaaaatccttcccactagtccaaactgcaacaaagatgcagaaaatgtcaccatcaagaagatcttcaaaaattaaaaaaaaaaaagttttagttagaataacagagctttgaaaagcaaatattccaaaccaaaagaaaggagggaagggaaaagaaaaacctgtatcgcaaactaaaaatcgagtcgtgattagtaatctacgagcagtaaaataggtaatgagaacagcattcacgcatatagaagggagaaacctagaagtaaatgtgagaagacactgtacacatgggtaaagtctctgtaagcacatgggtgaaatacgaaccagcagccatgtagggagtgggctctagggcccctttgccattaactcactgcacaaccttaggcaagtcttcctcctttcactgccttagttcttacatccataagaaaaagtccatcgtggtagttacttgtccataaagcaagttgagagccttgaacaaaaaaatattttggcaaaacatatgattactccctgtctaaaagcctactgaataggacacatatcaaacatatacagtttaaggtaccataatagacaccgtgtctattatgcaatcctctcgaataacaaatgcagcatatacacaccacagggtcaatttattgacataataatagtcaatttattattgactattattatgtcttctttctcacggcagaaaagtagttaatgctgtgctcttactctaatatccctgaatatcttactaagtcaatcaaaattaacaagcaaacttccattgtctctcctctggacaggggcagtcccttcctggccatccccaccacttcactctcaccctcattcattctccatgagacagctagggtgatctttttgaagatcacagtgcagtactcccctgcttaaaatcttcattttccacatctcttgtgttgaagatcaaaatactcagcagagctgagaaagcccagaacgaccctgtgtcctgtgcgccaccagcgtcctctcaccctgccctcctcctcaccttctctgctccacacagggtaggcattcagtaaatacttgttcaatgaatgaaaaggcaaacaatgggttttttgtgtgaacaatgtattaaggtttgtttctgaataagaagcaacattggccgcatgcagtggctcgcgcctgtaatctcaacactttgggaagctgagccaagcagatctttcaaggtcaggagtttgagaccagcctggccaacatggtgaaaccccatctctacaaaaaatacaaaaaatagcagggcatggtggtgggcgcctgtaatcccagctgctcgggaggcttgaacctggggggtggagactgcagtgagctgagatggcgccagtgcactccagcctgggcaacagatcaagactctgtctcaagaaaaagaaaaaaaagaaagaaagaaaaacgaagaagaagcagcaatatttgagtgaaccaaacaaatacatgattgagtttcaggcagcaacaactatcaagtggggaagaatgctgggagcaaggaccttccaacagccttgcatacccttgccctgccgcaacatgaaccacactgagctaaaggtaaaacctataaggacaagacttcagcaaattgcatgagatgatgtttcagctaccaacaccacagctaactcaaaacatctcctcctaaggcaaaagaaagtaacgcccagcgaggactaaagctaacacgcaggttaattccaggatcactaacaacaacggtctttgtgtaaaggatttatttgattacctatcatgtccatcagattaagataatcataaggagaaaaagaagagtgaagtcgtttcagctttgcaacagcacttcccacccatttgcagggatctgtttttcctgctgttgtgttaagggaatgaaatcactgcacaggccttttgcacagaggcagtgcaaaaggatttaaggatctttctaaaaccaggcttaagtcagagtgttctggcagtcctttgaaagaagttatctagctgaaacatcacttgcctcctcagaaaggtttggtgtcagctggaaaaggaaggaagctggaaggagggaggaggtgccctccttctctgaaggtgataatgataaatgaggatcaactaccagtatgatgggctaggccaacccatttttctcaggcttataccaaggtactgaatgataagtatgtcactcagatgatgatgacttcatcgcagctatgtgaaaagatcttgacaaccaggttttctctactggtgatggtgctaaattgctttgtctcctgagcactggcaactctgaattctaggtataaatgggtaaagatcagtaactgctcctaagcaccccagagcagaccctcacataataggttgtgtcatttgacagaatactgaaaggccaaacaaaataaaactaaactgttggatctagaggctgaaggatctttaaaggtaggagtgggagggagtgagggataaaagactgcacattgagtacagtgtacactgctctggtgatgggtgcaccaaaatctcagaaatcaccactaaagaacctatcatatgaaaaaaggctcaacatcactgataattaggtaaatgcaaatcaaaaccacaagataccaactcacaccagtcagaatggtgattattaaaaagtcaagaaacaacagatactggtgaggttgtggagaaatgggaatgcttttacattgttggtgggaatgtaaattagttcaaccattgtggtagacagtgtggcaattcctcaaagatttagaactggaaagaccatctgacccagcaatcctgctactggatatcaccccaacagacctggtggcctgccaaaaaaatattaaatcattctattataaagatatatgcacatgtatgttcattgcagctactactcacaatagcagagacatggaatcaacccaaatgcccatcaataatacactggataaagaaaatgtggtacatacacatcatggaataccatacagccataaaaaggaacaacatcatgtcctttgcagggacatggatgaagctggaagccattatcttcagcaaactaacacaggaacagaaaatcaaacaccacatgttatcacttataagtgggagcagaaccatgagaacatctggacacagagaggggaacaacacacacagaggcctttcaggggagggcgggtggggagagcagtagggaaaagacctattgcatgctgggcttaatacctaagtgatgggttgataggtgcagcaaaccacctggcacatgtttacctatgtaacaaacctgcatatgtaacccagaacttaaaatataataatttaaaaaaatagattgcatcatctgcaaacaaaaaaattcattaatgtaattgaaaaccacctgtttcccaaaaactattaaaataaaaatttaaaatagtttttaagtaggaattgtgtcatattagtctatttataaaaccagagtacccctaaaggaaatcttcaataaaattaataactaagttagaagattttaagtcatatgatttgtggctgtggaattcaaccaataatgaaattggagatgaaatgcacagtttgggggtatgagataaaaagcaataaaaacattttaaatatagccaaccactttaaatgagcaggtgcttgaatcaatatcccacaactgcaaaaattttagtgaacctaaagtattgtctctatggcaaagtaaaaaaggaagaaagaagaagaggaagaggaagaggaggaggaagaggaggaaggagaaggaggagaagaagaagaagaagagaaggaagaaggaagaaggaggaggagggagaaggagaagaggaggaaggagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcaatccatggactccagagccccaagtctcctttaggccgacctgagagcttgctccagtctaataccctgatgtaagcccaggactggggtgggagccaaaactttaggcccagctctctgaaactggaacttcaaccaatttccgtcttatttattggtagcccttaacacctaaatctttaaaactttccattatctggtcttagtattttttgtttgtttgttttttgagacagagtcttgctctgtcacccaggcggtagtgcagtggtgcgatctcggctcactgccagctctgctttcgggttcacgccattctcctgcctcagcctcctgagtagctgggactacaagcacccgccaccacgcctggctaattttttgtatttttagtagagatggggtttcaccgtgttagccaggatggtctcgatctcttgacctcgtgatccgcccgccttggactcccaaagtgttgggattacaggcatgagccacacagcacccggcttttttttttttttttttgagatggagtctcgctctgtcgcccaggctggagtgcagtggcatgatctaggctcactgcaacctctgcctcccgggttcaagtgattctcctgcctcagcctcctgagtagctaggattacaggtgcatgccaccatgcccggctaatttttgtattttttcagtagagatggggtttcatcctgttggtcaggctggtctcgaactcctgacctcatgaatccgcccgccttggcctcccaaaatggtgagataacaggtgtgagccactgcgcctgcctggcgtggtcttagtattattaaagggtggtttggtagttttttgtttgttttgtttttgagacggagtcttggagtctcgcctgttgcccaggctggagtgcagtggcgcgatctcggctcactgcaagctccacctcctgggttcacgccattctcctgcctcagcctcccgagtaactgggactacaggtgcccgccaccacacccagctaattttttgtattttttagtagaaacagggtttcaccgtgttagccaggatggtctcgatctcctgacctcgtgatctatctgccttggcctcccaaagtgctgggatgacaggcgtgagccaccgcgcctggccaagtttcgtagttatttttgacacttgttttgtttccttcttcagaaagatagaaaccactaaagttcaaaatggcggggtccctctcttcattggaggcaatctggaattgaagcaaaaggaacaaatgtgttaaaagcctgactctctaggtgttgtatttataggcccttttaattactcttaccatgacttttttagctcaggagtgagacctatcctctgttttgttttattgttttaagtttgtcagaaaatttattgtttctaatatgtggtcctatactagtaatatcagtattatttttaaggcaaatgggttagcacattttcaagagtcacagtcagactctcaagctagtgtgaggtattcagaagccttcacacccaacagcaagtgactaagcatctgaatttctgttcaggctccctttgcagccctgtacctccgttatgccaatgctcagtgcagcatttgtggatgagaatttgcctgatgggactcaccttcagccaggaaccaagtttatcaaacactggaggatgaaaaatacaggaaatgtaaagtggagtgcagacacaaaggtaatttttcccacaaaatgcaaagatgaggtgatttgaagtggcagagtgctcagctgacaagcttgctttctcttcttactgttcttttcagctcaagttcatgtggggaaacctgactttggcttccacagaaaagaaggatgttttggttccctgcctcaaggccggccatgtgggagttgtatctgtggagttcattgccccagccttggagggaacgtatacttcccattggcgtctttctcacaaaggccagcaatttgggcctcgggtctggtgcagtatcatagtagatcctttcccctccgaagagagccctgataacattgaaaagggcatgatcagctcaagcaaaactgatgatctcacctgccagcaagaggtgagcattgactgacaggctttggcctagtatccaaatcttagttagagaggagatggctaaaactaaaagaacccactcatagctggttgttttccagaaaccttgaaaggttagcatctccccccgccccaacacatctctatgctgatatttggcctcttccttagggtgtttgttttagcgtctttagggtcttgctgcatactgaatacttttgtacctctttgtgatgttgcatggtcagcctgttggctgcacaagggaaaaagggactcctggcctgggctggcctgtggaactgctgaactgatagctttactccttaacatccatctctcctgaaataccctgtgtatgttccctaaatactaatgaagtcttgccctggttgctacttagtgaacagttttttaatgcaatttctctgtattagtggggcagagtgtttactgcttaaagttatccaatgttaattttctggttttgactattatagttaatataagttatcgtcattaggggaagctggggaatgtgaattctctctgctgtttttacaactttttctataactgtaaaaatatatcaaaaacattgttttttaaaatatggaggtacagcagcgtttttatttttgggggcattgtcagcctgcctcttcagttctgttgaaggcctaaaatttgtctcaatggtttgtctctataggaaacttttcttctggctaaagaagaaagacagcttggtgaagtgactgagcagacagaagggacagcagcctgcatcccacagaaggcaaaaaatgttgccagtgagagggagctctacatcccatctgtggatcttctgactgcccaggtggaagattcagcactttgaagggcaagggacagagggagagagcacaggagagaaggtggtagagccataggcagtaatcaggaaatcagagatatgcccactttgatctagtcaggtatatttaatgggaaggagatcacccatggaagcaagtttgtaaactagatgtttcctctttgaattgggaactcaatcctgtacttccccacaaactccctttagttgcctcttcaccttggcctagctaattctccttcatacctgctgcattttctctttcctgctattgggttatttcaacatctaattcccatttaactcttcttgttttcacttgtctggggacaggcatgaatttgaacagagttgaatacgaaatgatgtggaaatggtctacaggtcccatcaagacatggctccagcatgcactccaaacagcctaacattgtctttttttataggacctgctgtcctttgagctgttggatataaacattgttcaagagttggagagagtgccccacaacacccctgtgggtaagaatgtcactcatttcatcttgttcgtcttactaataggcacaaaagtaccacagcctagacactggtagtgttttattctgaggaaatggcaaggatttctcccacagtaggatagtaaagcagcaatcatggatccgtttttcttctttcctgtcctttgtcaaaagtaacaacatgctgggcatggtggctcgtgtctataatcccagctctttgggaggccaaggcaggaggatcacttgaggccagggtttgagaccagcctgggcaacatggtgaaacccccatctctacaaaaattacttttaaaaattagctgggtgtggccaggcacggtggctcacgcctgtaatcccagcactttgggaggctgagacgggcagatcacctgaggtcgggagtttgagaccagcctgaccaacatggagaaaccccttctctactaaaaatacaaaattagctgggcatggtggcacatgcctgtaatccgaactactcgggaggctgaggcgggagaattgcttgaacccagaaggcggaggttgtggtgagctgagattgcaccattgcactccagccaggacaacaagagcaaaactccgtctcaaaaaaaaaaaaaaaaaaaattagcttggcatggtggcctgcacctgtggtcccagctaccagggagactgaagtgggagaatctcctgatcccaggaggcagaggctgcagtgagccaggattgtgccattgctctccagcctggatgacagagtgaaacccaatctcaaaaaacaaacaaaaaaaagaggctgggcacggtagctcacgcctgtaatcccagcactttgggaggccaaggctggtggatcacaaggtcagaagttcaagaccagcctggccaagatggtgaaaccccatctctactaaaaatacaaaaattagccaggcatggtggcaggtgcctgtaatcccagctactcgggaggctgaggcagagagttgcttgaacctgggaggcggaggttgcagtgagccgagattgtgccactgcattctagcctgggtgacagagcaagactgcatctcaaaaaaaaaaaaaaaagcaataaaacaagttcgtgcaaggcttttccactataaaggaatcctcttctcttttttccctctagatacttgtgtccttttgttcctttatgttcatggttttgtgtcttggccacagctttccaggctaaataactgtgattcttcctgcattgattgatctgagatattttgcttacttattggtctggagaaattttttgtaacagacctcaaagcatatcttggtttattttagccctgcgggaggcaagaagcctacaaactgctacttctggacactgactgttgatgatatgatgctttctcttgattgatggttctcctgtcttcattctccagatgtgactccctgcatgtctcctctgccacatgacagtcctttaatagagaagccaggcttggggcagatagaggaagagaatgaaggggcaggatttaaagcacttcctggtaagggattaaacatttgtaaagtatttgcatcctccctttccatatcataccctattttacagctatcccctactgaccctaccttagcatgtaaatgggcttgctttctgtagcatctcatgttttgaagtctcctcaccttcacatggcacagatagcagctattccttggtttagttttagcatgggtaatgactggtgaatgttcttcagcactttaaacaccaagtgcagacaaagtttagatagcagctattccttggtttagttttagcatgggtaatgactggtgaatgttcctcagcactttaaacacccagtgcagataaggttcgtgtgtctttcagattctatggtgtcagtaaagaggaaggctgagaacattgcttctgtggaggaagcagaagaagacctgagtgggacccagtttgtgtgtgagacagtaatccgatcccttaccttggatgctgccccagaccacaaccctccttgcagacagaagtccttgcagagtgagtgtccttgcatttcccctacctagcagggtggcacctgaattgtgactgccagacttgactagttagatgtgctcttcttcactgagactgaagggagagtgatcttagttagaagttctgatcttggcggggcgtggtggctcaagcctgtaatcccagcactttgggaggccaaggcaggcggatcacaaggtcaggagatcaagtccatcctggctaacatggtgaaatcccatctctactaaaaatacaaaaaattagcctggcgacgtggcgggtgcctgtagtcccagctactcgggaggctgaggcaggagaatggcatgaacccgggaggcggagcttgcagtgagccaagattgcgccactgcactctagcctgggcgacaaagcgagactccatctcaaaaaaaaaaaaagaaattctgatcttgtttgtgtctttagactctacgtatgctacctgactgttctaattagagcatcaggagtaaagaagccatcatactcatttctccatcttctcaggggcagaattacagctgcattccacagtggaatagcagccagttgtgctgcctggattctgcagtaaggaatcttcctgtaatttgacagagctccttagcagagacccctatgggtagctgagttgtctgctttctccaagggcagcagtcccagaaacagtggatagaagcaggagtaccaacaaagtttctcaaggttaaattctgctgtaataaatacctttataggccgggcacagtggctcacccttgtaatcctagcactttatgaggctgaggcgggtggatcacctgaggttgggagttcgagaccagcctgaccgacatggagaaaccccatctctactaaaaatactaaaaattagccaggtgtggtggctacatgccaaggattacatgcctgtaatcccaggtacttgggaggctgaggcaggagaatcactttaacccgggaggcgaaggctgtggttagccgagatggcgccattgcactccagcctggcaacaagagtgaaactccgtctcaaaaaaaaaaaaaggaataaatacctttataacagaaacttctaggtatcagatagatagaaccaatagcatatattttaagaagtatccaaaaattcaaatatactatgtcaaaataatattggagaatctctttattataatcaaatttgacctatatctttaaatattatttatcttacttttgtttaaagtatacatgtaaggccaggcgcagtggctcacgcctgtaatcccagcactttgtgaggccgaggcggacagatcacaagctcaggagtttgagaccagcctgaccaacatggagaaaccccatttctactaaaaatacaaaaattagctgggcgtggtagcgtgtgcctgtgatccagctactcaagacgctgaggcaggagaactgcttgaacccgggaagccaaggttgcagtgagctgagatcgcaccactgcactccagcctgggtgacagagcgagactccgtctaaaaaaaaaaaataataaagtgtacatgtggccaggtgcggtggctcatacctgtaatcccagcacgttgggaggccgaggtgggcggatcatgaggtcaggagatgaagactatcctggctaacacggtgaaaccccatctctactaaaaatacaaaaaataagctgggtgtggtggcgggcgcacctgtaatcccagctactcgggaggctgaggcaggagaatggcgtgaacctgggaggtgcagcttgcagtgagctgagatcatgctactgcacttcagcctgggcaacagagtgagactccatctcaaatcaatcagtcatgtatatctttatatttttttccacatgtgtgtacaaatacataacaaaaaggtctggaaagacagtaccaaaatgttcacagctgttattctgataggatttatgggtaattttttttttttttttgagataaggtctcactcgcccaggctaaagtgcgagtagcaagtttatggctcattgcagccacaacatcctggggtccccctacctctgtttcccaagcaactgggaccacagccacatgctaccacaatgagctaaatttttttttttttgtagagatgggatttcgccacgttgcccaggctggtcccaaacttctgagctcaagcagtctgcctgccttggcctcccaacgtgctgggattttaggcgtaagccaccacacctggcctgggtagctttttttttttttgggacacagtctctgtcacccaggctggagtgcagcagcgcggtctcggctgactgcaacctccgccttcccaggttcacaccattctcctgcctcagcctcccgagtagctggcactacaggcgcccgccaccatgcccgggtaatttttttgtatttttagtagagatggggtttcaccgtgttagccaggatggccttgatatcctgacctcatgatctgcccacgttggcctcccaaagtgctgggattacaagcgtgagccaccgtgcctggccctgggtagcttttttctatccttttttaccctctcaaacatgattggccagttttctcccatgactgcatcatctttgtaaagaagaggaggagatagacatataatcctgcaatactcatctcctaactttttctctttttatagcactgttagtgtatcagttttggtttaaactctactcagtatattaaccatcacataaaaaggaaaaaagggatggagctgcctccttttatgattcatagagcttcttggaaacctgagtgtttctgcctaccttgtttctgtgagctttgattctattttgttttgcatagtcttcaaacttagaatatggtcatagttccagaaccagcccttccctttagttcttccctctcctctggctttcataattctagcttatgatccacaaggctttaccaagtaaggatagtacttaggcctgcttttagcttccaccttaaaattggttgctttcatcctttagtgacatttgccttgcctgaaggaccacttggaaatgagaaggaggagattatccatatcgctgaggaagaagctgtcatggaggaggaggaggatgaggaggatgaggaggaggaggatgagctcaaagatgaagttcaaagtcagtcctctgcttcctcagaggattacatcatcatcctgcctgagtgctttgataccagccgccccctgggggattctatgtacagctctgcgctctcacagccaggcctggagcgaggtgctgaaggcaagcctggggttgaggctgggcaggaaccagctgaggctggggaaagactccctggaggggagaaccagccacaggagcacagcataagtgacatcctcacgacctcacagactctggaaacagtgcccctaatcccagaggtagtggagcttccaccgtcactgcccaggtaccactcacagccccctcagctggggtgttcttcagaggtgaaataaagagaggaatcgacctgatctcaaaacctgttttttcctcagtatggaaagagactattttccatagcaaagtctgaatttagatgaataaaagttgtatttcccagtatttgtggattctggatttaaagaaatatttgttttagttggccttaaattatctgagtatagtctgtctgcttatattttgattattgagagctggttggtggtttttttttttttttttttgagacagggtctcagtctgttgcccaggctggagtgcagtggcacaatcttggctcactgccacctctgcctctgaggctcaagcaatcttcccacctcagccccctgagtagctgggactataggcatgggccaccacacctagctaatttttgtatttattgtagaagcggggttttgccacgttgtccaggctggtcttgaactcctggccttaagcgatccaactgcctgggtctcccaaaatgctggaattacaggtgtgagccactatgcctggctgagagccagtttttaaacacaaacatccctggaccttccctccttgttttattgactcttcagtaaaggcagcaaaaactcaacccaaacagtcataattaggaagttaaatccattatgggaaaaaacactataaaaccaaactaattatttttaattctctggtgaatctatctgaatcattcttgtctcctaatagtagggaaaatgctggagccttgactataatgtaaaccattctccccaaaagctagacatttccgtttattgacaccacttgatataggtggggacatgaccagactgaagccaacatttctagcttgcctgtggctaaagaggaaaatggggtagaatgtagcccttatgatggaaccctaaatccagacatgtgatctggatcagaaatgtgaagcctctgtagagaatttggcactgctgtgctgtgtttactatttctccactgttgccataagtgccttttcaatttactttccatattgtgtctttctgaaaggagctctccttgtgtacatcatcatggttccccaggagtggatttaccagttaccataccagaagtttcttcagtccctgatcagatcagaggaggtaatgatcagcctaagctttttctctttttctctgctcctgtctaatggaaaccaggtataaatagcctctctctcttcgtgattcttggtggttttttgaaacttgcccttcacaggccaggcgtggtggctcacacctgtaatcccaacactttgggaggccaaggcaggcggatcatagggtcaggagttcgagaccagcctggccaacatagtgaaaccctgtctctactaaaaaatagcaaaaattaaccaggcatggtggcgggcacctgtaatcccagctacttgggaggctgaggcaggagaatcacatgaacctgggaggcggaggttggagtgagccgagatcgcaccattgctctccagcccgggcaacagtgcgagactccgtctgaaaaaaaaaaaaaaaaaacttgcccttcactctctccatgctcctcctgcatactctaatttctattctctggctgaatatattgttagacctcatagaggtagtggaaagaacacaggctttggagccaaacaatctaggttccagctccatctccccctttcctgactagcagttcagcaggtttctaatggctgtgagtctgttttcttactacaaaatatatcagtgtgttaggattatagagttgatttttctgattcaataaacaatcatcttgcattgcatttctggacagtttctccttatcacttaaactacccttaaaacttcccaaatactttaaaaaaaaaaaaaaaagacttcaaacactgtgatcagattgccacctgcctcaataatagccttgctgtgagttaggaaacagtaggtgcttatggatgctgcatctaaccaacagctcttttgcttttagagcccagaggctcatcaggacttgtaaacagcagacagaagagctatgaccactcaaggtaacaaccttgtgcagtctcttttttcagaagcaggtggatattcttgtattccttctgcttaaaagagcctctcacagtatgtacccatcttcagagagcagagaaggggagcctttgttccgtcttattcttgtttcttctaaaggctttgagcaacactgaacaaacggctaaagctgatgtttaagagtgttctgtttgggaggccgaggcgggtggatcatgaggtcaggagttcaagatcagcctggccaacatagcgaaaccccatgtctactaaaaatacaaaaattagccaggcatggtggcgggcacctgtaatcccagctactcaggaggctgaggtgggagaattgcttgaacccaggaggcggaggttgcagtgagctgagattgcaccattgcactccagcctggctgacaagtgaaacaacatcaaaaaaaaaaaagagtgttttatgtttcagacaaggaaatagtgtccacaaattacctcactcttagcactggggaaaaggtagaaaggttaagcccagtatacatttaaataattttttcttggacatacctggttctctgcttccactcatattaggccagtgtccagaaaatcacatttcctttgcaaggtgttttctctgagagaataattgagcagacaaactgttgatatccttgtgtgtcctcgatcacattaattttcagctaggagtgagagccatcatggttaccagagtggtgtgtttcctgcagtgcccctatcttgcttgcaccagtagagctgggccctccatcaaaccatgatctgtagctataaagctgataatgaaagcaattgtgttctctttttccatctaattttttctcttaaggaaatcttattccaaggattagagcccagattatcttgtaaaaaggtaatgatttgtgtttgtttggggagataatttggttttcctctgcaggcaccatcatgggagcagcattgctggaggactggtgaagggggctttgtctgttgctgcctctgcatacaaggccctgtttgctgggccaccagtcactgcacaggtcagtgtgtgtgttttattttcctgaatctcaactccatgtcaccagtgaaagtgatggcatctgtctgggttgaagagtaacatggcattgtggaaagggcataggctttagatttagtctttagttaacacacaacacaactctgccactttttttttttttttttgagacgaagtctcgctctgttgcccaggctggggtgcagtggcgcgatctcggctcactgcaagctccacctcctgggttcacaccattctcctgactcagcctcccgagtagctgggactacaggcgcctgccactacacccggctaattttttgtattttttagtagagacgatgtttcaccgtgttagccaggatggtctcaatctcgtgacttcatgatcttcccgcttcagcctcccaaagtgctgggattacaggtgtgagccaccgcacctggccaactctgccactttctaactatatgactttagccaagttacttaagggaagaaaagagaagaatgtattattgatgatctattaatattttctatagagagaagctattccaggtgttggcactatggcatgaataaaacaccagttcttggccgggtatggtggctcttacctgtaatcctagtactttgggaggccaaggtgggaggattgcttgagcccaggagtttgagaccagcctgggcaacatagtgagacccccatctctacaaaaaaatttaaaaattagataagtatggccggtacagtggctcacacctgtaatcccagcactttgggaggccgaggcaggccggatcacaaggtcaggagatcgagaccatcctggccaacatggtgaaaccctgtctctactaaaaatacaaaaattagctgggcgtggtggcaggcacctgtagtcccagctactcgggaggctgaggcaggagaattgcttgatccagggagtcagagcttgcagtgagccgagatggcaccacagcactccagcctggcgacagaacaagactccatcttaaaaaaaaaaaaaaaaaagtatgatggcatgcacctacagtcccagttacttgggaaactaaggtgggaggatcacttgagcaccggaggttgaggctgccgtagtgagccacaatggagccactgcactccagcttgggtgactgagcgagaccctgtctcaaaaaacaacaacaaaaaagacactgagtcttgcccagaaactatgggaaacaagtgaggtgcatggatacttaaagtacatagtaagatactatgctggccgggtgtggtggctcatgcctgtaatcccagcactttggaaggctgaggcgggcggatcgtgaggtcaggagttcgagaccatcctggccaacatgatgaaaccccgtctctactaaaaatacaaaaattagccaggcatggtgatgtgtgcctgtaatcccagctacttgggaggctgaggcaggagaatcacttgaacctgggaggtggaggttgcagtgagctgagattgtgctactgcactccagcctgggcaacagagtgagactccatctcaaaaaaaagaaagatactatgccagtgctatcagacagatgaaacacttcagcctggtgtgcccaagtaaggctttctggtagatgatgcctgaactgagtcctaaaggacggagtaaatgttcatcaggaaagagggagggaaagggtattgtagacagtgtagccagtaaaaaagacttggaaatgtgagcatggagtgtgaatccggtctaagaagaggagtaagacgaaaaaagactggctgggcttggtggctcacacctgtaatcccaacaggttgggaggccaaggctggtcgattatttgcgtccaggagttcaagaccagtttgggcaacagggcaaaaccctgtctctactaaaaacataaaaaattagctgggcatggtggtatacgcctgtggtcccagatactcaagaggccgaggtgggaagatcacttcagcccgggaggcagaggttgcagtgagctgagatcacaccactgaactccaatgtgggtgacagagtgagaccatgtctcaaaaaaaaaaaaaaaaaaaaggctgggtgtggtggctcacgcctgtaatctcaacactttgggaggctgaggcgggtggatcatgaggtcaggagttcgagaccagcctgacccacatggtgaaaccccatctctactaaaaatacaaaaattagctaggcgtggtgacgtgcctgtaatcccagctactcaggaggccgaggcaggagaatcgctttaacctgggaggcggatgttgcagtgagccgagattgcgccactgcacttcagcctgggtgacagagcgagactctgtctcaaaaaaaaaaaaaaagaaaaagaaaaacagaccaaatatgtaggcaggatgctgtgttatgaggtttggattttattttaaggctaattaataggaggagcaattgaagggttttaaggaagtgattgacatgatgagatctgtttttagtaagattaccggctacattgtagaggctggtagagccagtaaagaaatccagttgggcgtggtggctcatgcctgtaatcccagcactttgggaggccgaggcgggcagatcacgaggtcaggagttcaagaccagcctggccaatatggtgaaaccacatctctactaaaaatacaaaaattgccgggcgtggtggcacgtgcctgtagtcctagctactcgggagtctgaggcagaagaattgcttgaacctgggaagcagaggttgcagtgagctgaaatcatgccactgcactccagcctgggtgacagagcgagactccgtctcaaaaaaaaaaaaaggaaatccctaagagaatccatgtattggtggaaaggaagggtagaaaagataattaagagatggaaatggcataactttgagatgatgattaagtggctaaaaagaaggataggctgggcacggtggctcacatctgtaatttcagcactttgggaggccaaggtgggcagatcacttgagttcaggagtttgagaccagcctgggcaacatagtgaaaccttatctctacaaaaaatacaaagaaattagccggacttggtggcgcacacctgtagtcccagctacttggggggcttaggtgggagaatagcttgagccccagaggcagaggctgcagtgagctgaggtcatgccactgcactccagcctgggcaacaaagccagacactatcttggggtggaggggaaaaagtcaaggataaatcccaagtttctggcttagtaccattcattaagagcagaagaagagaactaggtcagttttgctggacagtgttgagtttgtggcatatccaggtaaaggtaaagatatccagagtgcagctggatatatagttgtccctcagtatctatgacggttggctccaggaccccctgtgggatactgaaatccatagatgcttaagtcccttatataaaatagtgtagtatttatatataacctaggcacatcttcttgcttgcttgtttagttttagttttttagatacagggtcttgctctgtcatccaggctggagtgcaataactagattgtagctcactgcagcctagaactcttggattcaagcaatcctctcacctcagcctcttgagtagcagggactacaggtgggcaccaccatgcctagctagttttttaaaaatctttttgaagagatggggtttcactgtgttgcctagggcaactaactcctggcctcaaaacaatcctcccacttcagcctcccaaattgctgggatgagaaacttgagccgctgcacccagcccatctcatatacttcatctctacattacttacaatacccaatacaatgtaaatgctatctgaatagttgttatacggtattcgggaataatgacaaaaaagtttgtacgtgttcctttttttctccccaaatattttcagtcctttggtgactgatccatagatgaggaacccacagataatggcaagccaacggtatccatccagatcacaggggagggatttggcctggtgatacatgcttgagagtcacttgcctacagattatagcagaagccatctgatggaatgagatgatccaggaataatggggaaagcaagaagcaacctttaaggatcagggaaaggaatactctgaaagaaagctgggaactaggaggaaaatgaagagagagagttctatgctggaacttaaggaagggtgttttaataagggggacatggtcaacggtgttagatgctacagagagatatgaactggtggtgaggaatttgagagtagaagtatgccacactttcaaatagacaggctacaacaggcagaagctaggatacataagacaagaggaagcatttttaaagttgggtgagactttagagatgggcaagccagcagtgaaagaggttaatgataaagatgagaagacagattggagatggagaaagatttctgaagtggtgagaggtaataagatacaatgcaaggtacattccattaacctgcaaaggaggatggataatctattctgaaataagaaggtagaatggaacagtggaatcaggtttggagggaaatgcttaacatgtttgcatactgttctcatctttacatactttttcaacaaccctgcaaagtaggaggtatgatatatcttcagttcataaaggaattgatagcacagttggtaagtaaatggaagattagggtttgagtctaagcctatctgcctcccaagttaataatctttctgctgcacagtttcagtatccccagtctgtgaaattgggataataacagaaccagaggccaggcgaggtggctcacatctataatcccagcattttgggagaccaaagttcaaggatcacttgggcccagaagttcaagaccagcctgggcaacatagggaaacctcatctctagtaaaaaatttaaaaatttgccgggcgtggtagcgcagaccagtggtcccagctatttggaaggctgaggcaggaggatcacttgagcccaggaggttgaggctgcaatgagctgtgttcacaccactgcacaccagcctggggaacagagtgacaccctgtctcaaaaaacaaacaaaacaacaacaacaacaaaacaagcgtttaaggatttaggaaggtaatgcttccaccacagggcttgaatgaatgaatgttaacttcctcttacctattcttgtttttttttttttgagatggagtctcgctctgtcacccaggctggagtgcaatggcgcgatctcggctcactgcaagctccacctcctgggttcacgccgttgtcctgcctcagcctcccgagtagctgggactacaggcgcctgccaccacgcctggctaattttttgtatttttagtagagatggggtttcactgtgttagccaggatggtctcaatctcctgacctcatgatccgcccgcctcagcctcccaaagtgctgggattacaggtgtgagccaccgcacccagcccctcttacctattcttttggaggagaaaaaatcaagaagccttcccaggttgtaatttcccaagctgttttttttgtccagctcctctgcatatctgacaaaatttcccatagcatctttcagtaacacttttatcttgctcatacttcccccatcatcacaattacacttatgttcacagggtctctggggcttgctgtcattccttcatctggccaaaaaatgcttcttcctgaaagccccgagtgaagcattctcctggttctaagtacagttcattagctccccggtttcccttttctcctccttcaagtacacagataactaatctaaaatagggccttcccagtccgaaccgttggtatcaagtacacaggagtgccatagccttgaatctaattacctagtactttgaataaatctggaaagactagtatgcttgcaagatgatacaaatgtataaaataaacatttaaattatacagaatttttttttttttttttgctttgcttgtctctacacagccaataatttctgaagatcagacagcagccctgatggcccatctctttgaaatgggattctgtgacaggcagctgaacctacggctgctgaagaaacacaattacaatatcctgcaggttgtgacagaacttcttcagttaaacaacaacgactggtacagccaacgctattgaggagtgaccttgtattaaataactgcctgctgctcagagatgatctttattctgtcattggggtatgggatagaagcccttgcttatttttaatctgatgaatctgtatagagcccatcgttgagttaccaagacaatacctgctacagtattttggggagcaaactaaagaccagaacttaaattttcactttagacattggatgaatagtatgaagacagtttttcagttgatttggataaaactattttagtgcattgacaagtgtaacttcaacttcatatagaaccatttttctttctgcttttattgaaactgagtatttttctttggctaatgtggattttttatggggatatctgttaattttcaggttttgaaagacattaacctcggaagttgtttttaagaattattctcataattcttattctcataatttctgtaatccacctcaagcttcatagttatttggcattgaaataacacccagagcatgatagaaatgttgttactcttcctctctcaaggagaaagtaattttcctgcaatacttaataattggcaccgttgctttctaaagactccatggtgcattcaagagtatccaacttcaagggaatctccgcatttcaatgaaaggaggaagagtgtgctgataaacctaccagcacctattgagcaatgtctattatagtaattttgcatacatttttatttaagggaaaaaatataggtattgtgaaatattttgctaatcttatagaaaaggaaaaaatcccgttatttaaagggaaaagtaaatttaacagttgccttttttcttaatgtcagggcagatcttattttacagtacagtgggggaaatagaaacatgtgaaaggcaaaaggcaggctcctaaattaatgtcagtgaagttcagggtgggcaaatgagtgtgtgtgaggtataggaaatgctgatgacttctttaatgcttgaagtccgttcacaggtatctagccctagaatgcctagaacaggaagaggcagctggtgttctgcaaaacttggacaggggcaaagttgctgaaaaagttttggtttaacccgaagataagtggaaaagagcttgtccatgaacccaggttctcactctgtttacagaagtgtgttgagtacagttggtgaaggaagaggtaacaaaaaatgctaaatattttatccatgaaaatgacttccagaaaaggaagaatatgaaccccagaccgaaggggaaaagatagttaatagtattatctaacctggttggtatttgtaatgaatggtgattttaattagtcattagccataatgatgtttatttacagtataactcctgaatgctacttaaataaaccaggattcaaactgcaagccagccaggccgttcattatttaaaacgttttaatcggggcttccgggtagaaggtggagcggcagggtgtaattgggttgatgggtgggacctgtcttgaccatcggagttttataatcgagggccaggagggcccgggttgctctcctggttatgtatgtacttgtacataaccacctaaagaatggtgaaataaatgttcttggaaattcctacccggactggctagtccttgcggaagcagcgtccgggccctcgggtaacgtttgaagagctggcagcgtctcaggctgctgcgtggcgaaggggcggaccgggggacgggggggtgggcccttaggggctggggcgggacttccctgggcactgagtcaaagcttgaggggagtgttcgctcccgcattttcgattccactctcttccgtttctgtcgctgcagtcgtccgcgggtaaggccctccctagaccctttatacctactttacctttcggaggtcaagacacctcctgttgccgcctcctcgcccaacacacaggcgccccccgcacgggtaccaagcttgactaacggcctctaggggtgtgtggtgggacttgaaatcctcccttaatgaagtcacaccttctccgtccgcttccacccggtcggcccatggcagagcccccatgtagcccaggaatcggcttggcccttcggggaggtcagcgtccttactatccccactctccagtgcggcacattcgttcccctaggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaaggtgagcatccctatattttagcccagaaagatctgtgtggctcacttgccggcctcgttctgtcacacagagtccagatttagccttgagttttcctagtgaaagacagaccctggtatcactatgaccctcctcaggctttcttaccccgcctcagaaagcagtgaggtgtctgctttctcccagggcttctttagataggggtcttaaccacacctgtgaccagtctggcctcctctctccttgattcaaagaatctcttttctgccctatccaacttccttcccttaaactgaatgacagctcagcaacttttccagagaaaaattaaatgctctgacaatcacttatggaagttccttaaagtgaagtaacttctgcttttcttttgttttcccttttgtaggcagattggtctcttttaaaataatgaaaggagtcgaaatgcattgagacttctgagagtcccatgtgaccacccagtttttcacatcctatcttccttaggcttgagcttgcttaaactgtggtgaagctccttgccagtcttgagaacttcaaaccaaaattacatctggcgtcagtgctaacaagcttagcactgaactttggtcttttctcattagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaaggtgagtggcccaaggctctggaaatagcctggaatccagggaaagttcttagcctgttggcctggggcagcccctctgagtctccttggatggggttagatctgctcccagctcttgacctcccagtctcaggctggccagggagatacttaactatccttgggttccctgcaaaaacctgccctccttccctggttgtattctccagccccttgtgggaaagaaggattctagccactgtgcttctgagcaacactgtgtgtcctaggattcattcagttcaggaagttacaaatgaactttccaaagatgctgggcatctctgatttgctggtgactttcagagattcttcatacctattagtggaaatctcacttccattctagagatggcaaagctgagctgccaactttggtagcagagtccagtgcttccagtcctgctctggggcagatgtggcatgtttctaacattgctctatggtgtgggtggaggcgtgcttctgggaagctggcacagtaaatatttgtcacagttgcatcttggccctccctctcaccttctctctctctagagctggagaagcagttggtggctctcattccctatggggaccagaggctgaagcccaagcacacgtaagccccccttcctcccctagcttcacaagccattgcccctgggggctgctccctttgtctcccctgttttgatctcccttaatttcttcctattagttcttccatagaaagcctgagcctcagaggtaccagctccttacgtccaaggattttttcctgatttagaagctcctggaccgggtgtggtggctcatgcctgtaatcccagcactttgggaggccaaggcaggcagattacttgagctcaggagttcaagaccagcctgggcaacatggtgaaaccccatctctatcaaaaaaaaaaaaaaaaagaaaaaaaaaaagaaaagaaagaaagaaagaaaaaagcagcagctgtgggcacagcagatgtcacttgaggccacctggtgggcttccttaagcatcactgcttccagaaagcatggccccctctccaagacaggaaggatctggtagctctgcaagtcctcccaggaaggagggaacaagcatgtggccctggctgcaattgatttgaaaatgttatttttcttaagcacctcccttgctgaggcagttcagatttgcttgtttttcttctagtagagatgaaaaacctattgtccgctgttctgggatacttcagaacctcaggcagacctggggcctactgtgtttgtgatctgagtccatctgacatggagctccctcaacctcctcccaaggtcctggtgtcaacctgggagtcaccaccaagccgaaccctctccgccaccccactataccagaattagaaatcaggctgggcgtggtggtttatgcctgtaatcccagcactttggggaggccaagacaggcggatcacctgaggttaggagttcaagaccagcctggccaacatggcgaaaccctgtctctactaaaaatagaaaaattatctgggcgtggtggcagacaccagtaatcctagctacttgggaggctgaggcaggagaattgtttgaacccaggaggtggaggcttcagtgagccaagatcatgccactgcactccagcctgagcaacagagcgaggcctcatctgaaaaaaaaaaaaaaacaaaaaaaaaccctgtaatcccagcactttgggaggccaaggcgggcagatcacgaggtcaggagtttgagaccagcctgaccaacatggcaaaaccgcctctactaaaaatacaaaaattagccgggcatagtggcaggcacctgtaatcccagctactcaggaggctgaggcaggagaatggcgtgaacccgggaggtggaggttgcagtgagccgagatcgtgccactgcactccagcttgggcgacacagcaagactccatctcaaaaaaaagaaaaaaaaaagaaattagcagtgcacatcataagatactaacaaagtactatctctttaatgcatatctgaattttgaattggatggatggtgtcctgttctgaatgttaaaattcagaacttccaaatatggacttatttcttctagtgataataactagcattcattgtgcttttgccatgtgcagggacctgtgattagtattttttcatatattagccgataacaaattctgtgaggtcagtacaattatctgccttttaccaacaaggaaactgagacttaaggaggctaagtgggctgctccatgttattgggtcaatgggaacagagatctgggagtggaaaccaggctgcctgcctgccaatcctgtgctcctactcattccgggccacatctggggagctaaatgttgttggggtagtgtgcaggggaaagctttgtatatggagaggagtgtctgaaccccctctccgagtttccttggtgttcagacttttccattcctccatcctgggtcctgctttcccacaggaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacggtgggtgggtgcccttggctccaaaccccccttcctagcaatacttcgctgtaacctttgtccagtgttatgaccctgggcatgggaagccagagatcttatggcacccagagggtgttgggagcctgaagagaagtaggagcaaccatgagctccatgacagatggtaaggattgggactctacacagtaaggggtcagaatccgggccagataagtaaaccacaggggtggagtggggtgacagtgcctgagactctctggatggacaggactgaatggaaagaagctgtacaggatggacctggatcctgaggcagcttaacttcgtaaagttgacccctcaccattcaatgcccctccaaggggctcccagttttcatcctctgcacctgaagcttgtcatggtagatggggctcaggccagacagccaggcttttgcaactgtttggcttttcctaaggatgggccatcttcactcctcccttcccttgtcttcatccccagaatatcttaaacatctccaatggcaactactaccccattatggtgacacagctgaccctcgaggttctgcacctgtccctcgtggtggggcaggtttccaacaaccttctcctacacattggccctttggccagtgaacaggtgactcccctctccctggccagccctgcccactggtgtgtggatgtgtggtagtgggaaaggggcagctggagttggggctaaccctgtgcccatttggttgacagatgttttacgcagtagctaccaagatacgggatgaaaacacatagtgagtaccccttgatctcttctcccctagccacttgcctggcttagggacccaattaatacccaccagctttcctgattgcttagcaaattcttcagccagcatctggcctgccctcccatggccgagaatgtaataagcaagggttcagggtccccagcctctgcttgtttggaccttgattagaatgaaaaacaggctggaatttggttaatctttacaatatgtgaccttgggctcttcagcctgcattgctgaggaagaagaatgttttgtctgtctcctgaatgggggtccagcatgtgcctgggccaagtgagtggaggtcagagtgatagtgcagccatgctgctacactcacctgaagggtgggaaggggtgggagtgacattttgggggcacctgatggaaggaaagagttctgtggggtaaggaaactgggacctgcaggcatcttctgagctgacaggctgctccatgtgacacgtggtcccacgttctcttttcttctctctcagcaaaatctgtacctggctggaaatcaaagtccaccatgtgcttttgcacatccagtaagtagagcttggagctctggtatccctgctctcacttctgacttcattctcactcagctacacctcatgggcagagagtcttccaagctgaccccatgaatctttgttggctcttgggaatagcaagtctagccccttttctgagtctcaccttgcctataagttattaggggcaacaggcatagggctgtctggaagctgctggaaaacaggtggggcagctgtcccaggtaccttggcagagtggggagccagagggaagggcaaatgagggagctccccgctccccacccccagacagtataatggggccagagctttccttttcctcccagccatggcaacaaggcctgcttcctctccaggggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggctgtcccgtctgaatgtggagagagctgtagttttatctggcttttaaaacatggacctgccggctgggcgcagtggcttacacctgtaatcccagtactttgggaggccgaagtgggtggatcacttgagggcaggagttcgtgaccagcctggtcaacatggtgaaaccttgtctctactaaaaatacaaaaattagctgggtgtggtggcatgcgcctgtaatcccagctactcgggaggctgaggcagcagaatcacttgaaaccggaaggcagaggttgcagtgagccaagatcgtgcaactgcactccagcctgggcaaaagagcaaaactttgtctcaaaaaaagactcttttcaagttttctaccctctgataagaaaatttggggatatccagtgccatctccaaggactttcaggggatcatagatgcttttctgtgcctatctgctttgaccatgtgaaaaagtgatagtctgcttctctctggtaacttgtctgccacccatctgatagtaagattagccaaggccctttagccctctgtcctttctggttattgactgtccctggttcctaggaagacagagttgttctccagctaaagcgtctcctctctataaagtagttttactattcttttcatagcaggagccaaaatagtagaggaggggagagaggcacctggcactctgcgggcctgcacaggaaaaacagagccaaagacagaatcattgtataagatatttattaaaggagagcctctaagtccacatcctgagcccatgtgagtggacacaggtaggtaaaacggtgggtccagctgctgtcatctgaaagccttcaggagatgaagctatcagtatccagctgaaggctgctgggttctgttccaccaccaccttagcaccagggccctctctggtcccagaggcctcatctctccttgggctttgacaatgtggagcagcacatcagcagggactggtctagaccctccctttcctgtcacttagctggagctaagctccagataacccctaggttcccactggctcctagtagaaatagtttctgtactttagcagaacaggaaggatatttgttcattaaaggtggcttggtcttacagctgggtgcagtggtatatacctgtagtcccagctactcaggaagctgaggtgagaggatctctagagcccaggaattcaagtttaacatgagcagcaacattagcaagaccccgtttaaaaaaaaaaaaagagctgggcgtaatggcgcacacctgtaatcccacctactcaggaggctgaggcaggagaatcacttgaacctgggaggcagaggttgcagtgagccaagatcgcaccactgcactccagcctgggcaacaagggcgagactctgtctcaaaaaaaaaaaaaaaaaaagatggctgtctctttatcattcagacagaacgatgaacacaggtgagcagggaaagctaattttgaagtaggatgcatggagagggagaagtggtgacagaacttggtaactagctggctgggggaacgaggggaaggaaggagactgctgtctccaagctgaggtcagggtggtgttggcaagagcgcaaaagtccagggaagccaggctggagctgctgtgtatagactgccaaatgtgaagtatttatattgtattcaataaactatacttaagagtgttcaaaaaagtctcctgggagtgggaagggagctagtggatactccctatttcacaaacttttctttttttttttttttgagacagtttcgctctgttacccaggctagagtgcaatggcatgatcttggcacagtgcaacctctgcctcctgtgttcaagtgattctcgtgcctcagactccctgagtagttggggttacagacatgcaccaccacaccaaattaatttttgtatttttagtagagacagtgttttatcatgttagccaggctggtctcaaactcctggcctcaagcgatctgcccgcctcggcctcccagagtgctgggattacaggcatgagccactgcacctggcagaaactgtttccttaatgttctaacgggcagcaaggtttcttccccaggcctctgagccactgatgacatatcctgcccttctgttttccgtgagattgctcacaggacctcactctccctcttgctcccattgtgtatctctaaagtctcttccaattttactattcctgttctgtgccaccaccatcccgttatcttccccagctgctctcatcaggaaatttcgtgggttgcactgaaacggccccttcagaccaaaggcaatgctatgtaggctaaaatgaaatacgcagctgatgcctcggacggggcttgtgattgaggtgactgaggcagcctttctcagcatggaggaagaaaggctttcccagggcttgcaccttcctgaagtctaacacccagggcccccagccctacccactccttcaccttgggctggtgaacctctgggttgtctctgctagatggagaggctgagagccaggaagggagagggctgtgggttttagaaggcaagactccctccccttcccagggtcaggtgtcatgttcctgaggctatagcctccgtttcctccaagctctttcgctccatccctgcctccattgtccatttgacagctgagtgcccactgtaggccagccattgcactgggcttggaggtggggagcatcactgcctgccaccactttctgctgctgcaggcctgctctgatgtgatgcgacccctctcccttcccaggctatatctcagtaagcatgggcttgggggaatgggtgatggctccagtgacagtcataaactgaagccccccacagacttatcactgctgaatgagggcaggtagtgatagtagtaggagttgcatacttgggggggacccaagacccagttctcccattggctttgcctagagaagcataaacttgccttccactctctttccaccctctccatccccttcgtgagtcctcctgccctcttcctctcatccctgtctcataaagctgtccggtcccgtgattcttcccaggaaaaaaattacattttattcctggcagcctcctcttctagagtgggtggcttttggagtggagatattgctggatgctgagaagatgtggttgctcatctgcattttggggatggccatggggtcctgggttcaatctctggatcaccactgctgtatgtaattggtagactgagaagagggagagacaggaaacaaaacaagttagcagcttctggtttcagaacattgtgtgaaatcccttgagtccagaggaatcaaagtgaaatgtagcagcccactcttcatcctagaagtgctagcatcagtttctttcatctgttgcacctctgtcagagacacctttccaatgccttgcacaattgcacaattatatattcttgttaagagttgccatccaggccaggcgtggtggctcacacctgtaatcccagcactttgggaggccaagacgggtagatcttttgagaccagcctggccaacatagcaaaaccccatctctactaataatataaaaattagctgggcgtggtggtacatgcctgtaatcccagctactcgggaggctgaggcaggagaatcatttgaacccgggaagtggaggttgcaggtggagtgcagctgagatccagcctgggtaacagagtgagactgtgtctcaaaaaaaaagaaaaaggttgccatcctgagtttgatagcctacaatgagctggactccaagctaagtgcttttaatgctctttcctctggtctgtctgtctgtctatctcatcttttacccaggctggagtgcagtggtgtcgattctgtgcgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacgcagccataaaaaaggatgagttcatgacctctgcgggaacgtggatgaagctggaaggcctcattctcagcaaactgacacaggaagcgaaaaccaaacaccgcatgttctcgctcctaagtgggagttgaacagcgagaacacatgggacacagggaggggaacatcacacgccgggccctgacggggcgtggggggcaaggggagagagagcattaggacaaatagccaacgcatgcggggcttcaaacctagacgactggtggataggtgcagcaaagcaccgtggcacacgtgtacctatgttccaaacctgcacgtcctgcacatgtaccccagaacttgggagggggtgggggaaaccaaaagagcgagggagaggcggggggggggaagagagagagagagggaaagagagagagagacagagagaggagagagagagagagagagagacagagagagagagagagagacagagagagagacagagagacggagagacagagagagagagagagaaagagagagagagagagagagagagagagagagagacaggagaaagaagaactccgggtgggtcccattcctttaaaaggtcgccacccactcgactgccaagctgagatcctaaggacctccccaaaggaggaggtcgtggccttcccaaagcgcagtagccacggtggaaacgacagcgtgccgcataagcctaccgtctaccgcccgcacatcaggaacctcaaggtacttcagggaagcagttaagttaagccggcgcgtcacaggcactcggcgtgcaagccgccccgcaggtgctaccgtctcttacctccctctacttttaggaaacacgttgtatccccggagggggtgcaccgttcctggaggtactgcaataccaggtcgatgcgtggagtggacggagcaagctcctattccatctccctgctccaaaaatccatttaatatattgtcctcggatagaggacgtatcagatattaaactgataagaacagatactacacttgatcttagccaaaaggccgagaagcgatgcgctcgccttcgcgcccgccgtcaccgtcccactctcatccacattcaagtcgcggtgagagccccagcctcgctccttgccccattccctctgtctcgtccacagcgctattgacgcccttacactctcgggctgatttcttattctctgcctttgaaaagggaaatcttacacccgtgcttcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccttgaggttcctgatgtgcgggcggtagacggtaggcttatgcggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctctctctgtctctccgtctctctgtgtctgtctctgtctctctgtctctctctctgtctctctctctctctctctctctctctctcctctctcctgtctctctctctctttccctctctccctctctttccccccccccgcctctccctcgctcttttggtttcccccaccccctcccaagttctggggtacatgtgcaggacgtgcaggtttggaacataggtacacgtgtgccacggtgctttgctgcacctatccaccagtcgtctaggtttgaagccccgcatgcgttggctatttgtcctaatgctctctctccccttgccccccacgccccgtcagggcccggcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgacttgaatgtggatgagagtgggacggtgacggcgggcgcgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccttgaggttcctgatgtgcgggcggtagacggtaggcttatgcggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctctctgtctctccgtctctctgtgtctgtctctgtctctctgtctctctctctctctctctctctcctctctcctgtctctctctctctttccctctctccctctctttccccccccccgcctctccctcgctcttttggtttcccccaccccctcccaagttctggggtacatgtgcaggacgtgcaggtttggaacataggtacacgtgtgccacggtgctttgctgcacctatccaccagtcgtctaggtttgaagccccgcatgcgttggctatttgtcctaatgctctctctccccttgccccccacgccccgtcagggcccggcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatgagactccgtctaaaaaaaaaaaaaaaaaagtatatatatatattgcatgctacatgtgtaattttaaattctctttctttttttcttttttttttttgtttgagacagagtctcgttctgtcccccaggctggagtgcaatggcctgatcttggctcattgcaacctctgcttcctgagttcaagcgattctcctgcctcagcctcctgagtagctgggattataggcatgtgccaccacgccaagctaatttttgtatttttagtagaggcggggtttcaccatgttggccaggatggtctcgaactcctgaccttgtgatccacccgcctcggcctcccaaagtgctgggatgacaggcgtgagccactgcatccagccactaaattttctaatagccacatagaagaagaaatagggccaggcacagtggcacatgcctgtaatccacgctttgtggcactgagacaggaggattgtttgaagctaggagtttgaggccagcctgggcaacatagtgagacctggtctttacaaaaaattagctaggcatggtggtgcatgcctgtagtcccagctactcaggaggctgaggctggaggatggcttgagcccaggagatcaaggctgcagtgagctatgaatgggccgtcacactccaggtttggtgacagaggaagaccttgtctcaaaaaaagaagaagaagaaaaaacaagtgaaactaattttaattacttgtatttatttatttttttgtgtgcaacagggtctcactttgtctcgcaggctggaatatagtggcgtgatcacaaggcttaccgtagcccttgacctcccaggctcaagtgattctcccactgcagcctcccgagtagctgggactatgggtgcacactaccatgcctggctaatttttctatttgttttagagacggatttcaccatgataccaggctggtctgaaactcctgggctcaaaggatcagcccgccttggctcccaaagagctgggattacaggcgtgagccactgcacccagcctaataatatattttacttaaccccatgcatccaaaacatcaatatgaacatatcagtgaagtattttatattctttgttttcatactaagtcttcaaaacctagcttgaatttgaaacaacagcacatcttaatttggacactaaattttcatcaaaaatatttcattgatttagatttcataaatttacagttgaaaaagtagatgtacatatccaaattgtcccaaacatgcttaaaatttttccagtatgtatgttgttttaaaatatttatatttttgttgttgttgttgttgttttttaagatggatttttgctcttgtcacccaggctggagtgcaacggcgcgatcttggctcactgcaacctccacctcccaggttcaggcgattcccctacctcagcctcccgagtagctgggattacaggtgcgcgccaccacgcccggctgatttttgtatttttagtagagatggggtttcaccatgttggtcaggctggtctcgaactcctgaccacaggtgatccacctgccttggcctcccaaagtgctgggattacaggtgtgagccactgtgcccggctgggagcaagactggagcaagactccatctcaaaaaaaaaataaaataaataagtgaattaattaattaaaggccaggcatggtggttcacacttgtcaacattttgggaggctgaggtgggaggattgcttgagtccaggagttccagaccagccagggcaacatagtgagaccctgtctgtattacaataataaaatcaaataaagtttttaattttttttttgagacagagtctcactctgtcactcaggtcagagtgcagtggcactatcttggctcactgcaacctccacctcactgattcaagtgattctcatgcctcagtctccccaggtagctggaattccaggcaagcgccaccatgcctagctactttttgtacttttagtagagaccaggtttcgccatgttggccaggctggtcttgaactcctgacctcaactgatccacccaccttggcctcccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtccagtgattctcctgcctcagtctcccgaatagctgggactacagatgcgccctaccacacctggctaattttttgtatttttagtagagatggcatctcagcatgttgcccaggctgttctcaaattcctgagctcaggcaatctgctcacctcggcctcccaaagtgctgggatttcaggcatgggcccctgcgcctggcccctttcctttattaataattgccatattcagtcctcatgccacctctgttgaggaagttgtatcatctatcattttatggatagcgctgagcaataggccatccatacccaggcattttttcctttttttttttttttctttcagggagggtctcactctgttgcacaggctggagtgcagtggtgtgatcaccacttacggcagcctcaacctctggtgctcaagcgatcttcaccttagcctcccaagtagcttggactccaggtatgtgccaccatgcccagctagttttgtttttttttttcgttttttttttttttttaaacgaagtctcgctctgtcaccaggttggagtgaagtggcacgatcttggctcactgcaaccttttcctcctgggttcaagtgattctcctgcctcagcctcccgagcagctgggactacaggcacatgccacccacccagctaatttttgtatttttagtagagatggggtttcgccatgttggccaggatggtcttgatctcttgacctcatgatctgcctgcctcagcccctcaaagtgctgggattacaggtgtgagccaccgtgcctggctacccagctagtttttaaaattttttgttgttgttgagatggagtctcactctgttgcccaggctggtctcaaacttctgggctcaagcgatcctctcaccttgatctcccaaagtgctgggattataggcatgagccccacacacttggctttttttcaatttttttcaatttttttcaatttttttttttttttggagatgtctgaacctgaactcctgggctcaagcaatactcctgcctcagcttcccaagtagccaagactactgcacccagcttcctacccaaacatttttaatggtggcaaagaatagaggaatagaccatccagaagtaatttgaaataattctagtctcctccccttactcctgctaaggaggtttctctggactacacacacacacacacacactcacactctctctctctctctctctttctttctgtcacccagagtctgtctttcacagtctgtgtccctatcttaccttgagttgtgaatacccagtgtttctgatggggctagattggcatgggttcatgagacctgatgatgaaacaaagtacaggttactcatccagcagttttccaaggatggaatactgcaagcctggagtgcttgtgtctggtgacccagggggtgatgggggtgcagtgaggacaggctcctacctgggacagggcacagactgagcccttcctgaagattctcaactaggaagctgtgctgtggttccctgttccagacctcacggggctcagtatatctgttaataagcctacaactcatgtcccaccctctgatcacccccacctcctctgtcacgcttactctggaagaagggccgacagcttctcaaccactctctgcagaagttggaaggctcctttgcagccgtaggttggcattaacccacccagggggagttgaccagcaaggcattaaaggccgagggtacttgggagagtcagagagggtagggtggtagatatggattctacactacagggccgggatggaagcaaagggctcctctccttaccacctcccactcccaggctccagtccagagtctgtaaggattttctgcccaccctggaatctgttgttgatacagagattgccctccagcttagtagatccccgctgaagtaggctggtgacctggcctttgggaatcctggagattgcatttggaggtgtgctgagtacaacgggcttgagcacttggttgtgttggctgaggtggtggctgtggttgtggtggctgtggccctggccacacctgtgcctgtggcaatgttgatggctgtggtggtggctgtgatggtggctgcactgatggctgctgctgtgatggctgtggttgctcctgtgatgtccacaatttcgccactggtggttgcggcacatttaacttcttatgtggctggagtttttcctccgattgttgttcttcctcctggtgattcttcagttcctggcaagaagcccccgggcaagtggcatcatcctctccccacccaatcacccatctgccagagaaacttcagggaacaaggcaagtgagtagagaagtataggtggcagtggtctctgttccctagagctggaggctgaaattgggcctacgctgtctgcctcacccactgtgacacccaagaacgatttctgggtggcacagccccagcccaggaaatagcactctctctgagcacctgcttcctcacttgagagctcagcactgaaagcagtttttagtgctggaggataaagagtaattccctgcaaatgtcttgtgttttgttttttagagataggttcccactctgtcacccaggctggagtgcagtagcacttttatgactcactgtaatctggaactactgggctcaagtgattctcctgcctcagcttcgcaagtagctaggactacaggtgcacaccaccatgcccggttaattttttttttttaatagagacagggactcattatgttgcccaggctggagtgcagtaagtggtgcaatcttggctcactgctgccccaacctcccaggctcaagcgatccttccacctcagcctcctgagcagcttggactaaatgcatgtgccaccatgccttgctaatttttaaattttctgtagagacagggtccccctatgttgcctaggttggtttggaactcctagcctcaagcgatcctcccacctcagcctcccaaagtgatttttttaatagcccaagggtgcttctaaaccttacaagtgctttgaaatagcagtgtcaaataaaaatataattcatgctgggccggacgcggtggctcacgcctgtcatcccagcactttgggaagccgaggcgggcggatcacgaggtcaggagttcgagaccagcctgaccaacatggtgaaaccccgtctctactaaaaatacaaaaattagttgggcttggtggcaggcacctgtaatcccagctactcaggaggctgaggcaggagaattgcttaaacccaggaggcggaggttgcagtgagccaggatcatgccactgcactccagcctgggcgacagaatgagactccgtctcaaaaaaagaagaagaagaaaaaacaagtgaaactaattttaattacttgtatttatttatttttttgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatctagggagccctggaaatgtggtcagttctaatggagctgtgctgtaagtgtgaaatacacgtgggattttgacggcagtgggagcaaaattctcccaatttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttgctcaggctggtctccaactcccgacctccggtgatctgcccagctgccgcctcccaaagtgttgcttgcgattacaggcttgagccaccgctcaccctggctttttttttttttttttccagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcaggtgttcagaactccgattgggtgtcaccccgtgcaggaagccctcctttagtcaaggccctcggcacccgccccatatgtgactagcagccctcctgtgtatttcatcgcgcccccgttgtttatatcagccattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaagggggaaggtcgggctcggggtggcaggaccccagagggcaggggtggctgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccatggccagggttagggtgaggccactcctccagggcagaatttcagggggtgcccacccccccgccctaaatcattcagcaatcaacataaattatagttcaacgcaatgtatcttatcttgtgggccgcaagccacccaggtgcccaggcaagagcctgaaggcacaagctgttccagtacagcgaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcgtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtgcacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatctagggagccctggaaatgtggtcagttctaatggagctgtgctgtaagtgtgaaatacacgtgggattttgacggcagtgggagcaaaattctcccaatttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttgctcaggctggtctccaactcccgacctccggtgatctgcccagctgccgcctcccaaagtgttgcttgcgattacaggcttgagccaccgctcaccctggctttttttttttttttttccagacaaactctcgctctgtcgcccaggctggagtgcagtggcgcgatctcggctcactgcagcctctacctcccgggttccagcgattctcctgcctcagcctcctgggtagctgggattacaggcgcaggccaccacccccggctaatttttgtatttttaggggggtttcgccatgtcggccaggctggtctcgagctcctgacctaaggcgatccgcccgcctcggcctcccaaagcgctgggattacaggcgtaagccaccgcgccgggctctttcattctgtctttattttctgagaaaaagtctcgctcggacgctcaggttggactgcaacgggcgtgatctcggctcgctgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggccacccataactgtgaatgtgcaggaaccctgacttaggttcctggggaatgagagtttggttcccggtacccagggaaaccaccagcatcggcagaggtgatagctggggaggagcggggatttggacgagagacacaggatgagtaccgggggcagccctgtgatcaacaactgctgcaagaggggccgtttgttcgactcactagtcttctgtggctctatgcggtactaaagagcagaagacagaagatacaaaaaccacaaaaattagccgggcgtggtgctgcgcgtcaataatcccagctactcgggaggctgagatgggagaatcgcttgaatccgggaggtggaagtttcagcgagctgagatcacgccattgcagtccaacctgagcgtccgagcgagactatctcagaaagtaaagacagaattaaagtgcccagcgcagtggctcacgcctgtaatcccagcgctttgggaggccgaggcgggcagatcacctgaagtcaggagttcgagaccagcctggccaacttggcgagacctccttaaaaatacaaaaattagctgggcgtggtggcaaacacctgtaatcccagctacccaaggaggctgaggcaggagaatcactggaacccgggaggcagaggctgcagtgagccgagatcgcgccactgcactccagcctgggtgacagagcaagactttgtctctgaaaaaaaaaaaaaaaaaaaagcatgggcgcggtggctcatgcctgtaatcccagcactttgggaggctgaggcgggcagatcatgaggtcaggagatcgagaccatcctggctaacacggtgaatccccgtctctactaaaagtacaaaaaaattagccagacgtagtggcaggtgcctgtcgtccccgctacttgggaggctgaggcagaagaatggcgcgaacccaggaggtggagcttgcagtgagccgagatgcgccactgcactccagcctcagcgacagagtgagactccgtctcaaaaaaaaaaaaaaaaaagcttgggccagtggctcacacctgtaatcccagcactttgggaggcggcaggcaggcggatcaccagaggctgggagttggagaccagcctgaccaacatggagaaaccccaatctgtactaaaaagcctctgaggaagagtgggggaaagatgccacagagaaaagactttactgctgaattgtccatggggcccactgagactcaaagctaaggtgggaaggtcttctatctgatcaggacccaggagagaaagatactttgcagatgtttcctgggagccttgggaaaaatgcctccctccctcaacaaagcaggcggggcctgcccagttgccctggcagtaaccacattgtgaggtggttccagttataggcagaggggtctgagtgggaagagacagaggtggtgggagcagtgggctcagcctttacttcgccgcccgagggcggggagaccggccccgtacccgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaatgctgcctctctgctcgggacgtggattcctttcccctcctcctcgcctggctacttctgacgcaggtcgtcaggactccgcttgggtgtcacccgtgcaggaagcctcccttagtcaagggccctcggcacccgccccatatgtgactagcagccctcctgtgtatttcatcgcgtccccgttgtttatatcagctattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaagggggaaggtcgggctcggggtggcaggaccccagagggcaggggtgactgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcagggggtgcccacccccccgccctaaatcattcagcaatcaacataaattatagttcaacgcaatatatcttatcttgtgggccgcaagccacccaggtgcccaggcaagagcctgaaggcacaagctgttccagtacagcaaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgaccagaagacaagagtgtgagccctcattcacgcccagagaagggccgctggagggctccttggcctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatctagggagccctggaaatgtggtcagttctaatggagctgcgctgttaagtgtgaaatacacgtgggattttgacggcagtgggagcaaaattctcccaattttttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttgctcaggctggtctccaactcccgacctccggtgatctgcccagctgccgcctcccaaagtgttgcttgcgattacaggcttgagccaccgctcaccctggcttttttttttttttttccagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtcagaagtagccgggcgaggaggagggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgtcccctcgggtacggggccggtctccccgcccgcgggcggcgaagtaaaggcccagcgcagcccgcgctcctgccctggggcctcgtctttctccaggaaaacgtggaccgctctccgccgacaggtctcttccacagacccctgtcgccttcgcccccggtctcttccggttctgtcttttcgctggctcgatacgaacaaggaagtcgcccccagcggagccccgctcccccaggcagaggcggccccgggggcggagtcaacggcggaggccacgccctctgtgaaagggcggggcatgcaaattcgaaatgaaagcccgggaacgccggaagaagcacgggtgtaagatttcccttttcaaaggcggagaataagaaatcagcccgagagtgtaagggcgtcaatagcgctgtggacgagacagagggaatggggcaaggagcgaggctggggctctcaccgcgacttgaatgtggatgagagtgggacggtgacggcgggcgcgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccttgaggttcctgatgtgcgggcggtagacggtaggcttatgcggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctttctctctctctctcaatgtcggtgactggaatggctgatatatacgactggggcgcgatgaaatacactcgatggctgctactcacatatggggcgggtgccgagggcccttgactaagggaggcttcctgcacgggtgacacccaagcggagtcctgacgacctgcgtcagaagtagccaggcgaggaggaggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgtcccctcgggtacggggccggtctccccgcccgcgggcggcgaagtaaaggcccagcgcagcccgcgctcctgccctggggcctcgtctttctccaggaaaacgtggaccgctctccgccgacaggtctcttccacagacccctgtcgccttcgcccccggtctcttccggttctgtcttttcgctggctcgatacgaacaaggaagtcgcccccagcggagccccggctcccccaggcagaggcggccccgggggcggagtcaacggcggaggccacgccctctgtgaaagggcggggcatgcaaattcgaaatgaaagcccgggaacgccggaagaagcacgggtgtaagatttcccttttcaaaggcagagaataagaaatcagcccgagagtgtaagggcgtcaatagcgctgtggacgagacagagggaatggggcaaggagcgaggctggggctctcaccgcgacttgaatgtggatgagagtgggacggtgacggcgggcgcgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccttgaggttcctgatgtgcgggcggtagacggtaggcttatgcggcacgctgtcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctctctctctctctttctctctctctctctctgtctctccgtctctctgtgtctgtctctgtctctctgtctctctctctgtctctctctctctctctctctctctctcctctctctgtctctctctctctttccctctctctctctcttcccccccccccgcctctccctcgctcttttggtttcccccaccccctcccaagttctggggtacatgtgcaggacgtgcaggtttggaacataggtacacgtgtgccacggtgctttgctgcacctatccaccagtcgtctaggtttgaagccccgcatgcgttggctatttgtcctaatgctctctctccccttgccccccacgccccgtcagggcccggcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggataaagaaagtgtggcacgtatacagcatggaattactacgcagccataaaaaaggatgagttcatgacctctgcgggaacgtggatgaagctggaaggcctcattctcagcaaactgacacaggaagcgaaaaccaaacaccgcatgttctcgctcctaagtgggagttgaacagcgagaacacatgggacacagggaggggaacatcacacgccgggccctgacggggcgtggggggcaaggggagagagagcattaggacaaatagccaacgcatgcggggcttcaaacctagacgactggtggataggtgcagcaaagcaccgtggcacacgtgtacctatgttccaaacctgcacgtcctgcacatgtaccccagaacttgggagggggtgggggaaaccaaaagagcgagggagaggcgggggggggggaaagagagggagagagggaaagagagagagagacaggagagaggagagagagagagagagagagagagagagagagagacagagagagagacagagagacagagacagacacagagagacggagagacagagagagagagagagagagagagagacaggagaaagaagaactccgggtgggtcccattcctttaaaaggtcgccacccactcgactgccaagctgagatcctaaggacctccccaaaggaggaggtcatggccttcccaaagcgcagtagccacggtggaaacgaaagcgtgccgcataagcctaccgtctaccgcccgcacatcaggaacctcaaggtacttcagggaagcagttaagtcaagccggcgcgtcacaggcactcggcgtgcaagccgccccgcaggtgctaccgtctcttacctccctctacttttaggaaacacgttgtatccccggagggggtgcaccgttcctggaggtactgcaataccaggtcgatgcgtggagtggacggagcaagctcctattccatctccctgctccaaaaatccatttaatatattgtcctcggatagaggacgtatcagatattaaactgataagaacagatactacacttgatcttagccaaaaggccgagaagcgatgcgctcgccttcgcgcccgccgtcaccgtcccactctcatccacattcaagtcgcggtgagagccccagcctcgctccttgccccattccctctgtctcgtccacagcgctattgacgcccttacactctcgggctgatttcttattctctgcctttgaaaagggaaatcttacacccgtgcttcttccggcgttcccgggctttcatttcgaatttgcatgccccgccctttcacagagggcgtggcctccgccgttgactccgcccccggggccgcctctgcctgggggagccggggctccgctgggggcgacttccttgttcgtatcgagccagcgaaaagacagaaccggaagagaccgggggcgaaggcgacaggggtctgtggaagagacctgtcggcggagagcggtccacgttttcctggagaaagacgaggctccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaacgctgcctctctgctcgggacgtggattcctttcccctcctcctcgcccggctacttctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagccattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaagggggaaggtcgggctcggggtggcaggaccccagagggcaggggtggctgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcagggggtgcccacccccccgccctaaatcattcagcaatcaacataaattatagttcaacgcaatgtatcttatcttgtgggccgcaagccacccaggtgcccaggcaagagcctgaaggcacaagctgttccagtacagcgaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgccccagagaagggccgctggagggctccttggcctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatctagggagccctggaaatgtggtcagttctaatggagctgtgctgtaagtgtgaaatacacgtgggattttgacggcagtgggagcaaaattctcccaattttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttgctcaggctggtctccaactcccgacctccggtgatctgcccagctgccgcctcccaaagtgttgctttcgattacaggcttgagccaccgctcaccctggctttttttttttttttttccagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggaagaagttcctactaggaagacacgtggacacgtatgtttactgcagcactatttacaatagcaaagacttggaaccaactcgaatgcccatgaatgataggctggataaagaaagtgtggcacgtatacagcatggaattactacgcagccataaaaaaggatgagttcatgacctctgcgggaacgtggatgaagctggaaggcctcattctcagcaaactgacacaggaagcgaaaaccaaacaccgcatgttctcgctcctaagtgggagttgaacagcgagaacacatgggacacagggaggggaacatcacacgccgggccctgacggggcgtggggggcaaggggagagagagcattaggacaaatagccaacgcatgcggggcttcaaacctagacgactggtggataggtgcagcaaagcaccgtggcacacgtgtacctatgttccaaacctgcacgtcctgcacatgtaccccagaacttgggagggggtgggggaaaccaaaagagcgagggagaggcggggggggggaagagagagagagagggaaagagagagagagacagagagaggagagagagagagagagagagagagagagacagagagagagacagagagacagagacagacacagagagacggagagacagagagagagagagagaaagagagagagagagagagagagagagacaggagaaagaagaactccgggtgggtcccattcctttaaaaggtcgccacccactcgactgccaagctgagatcctaaggacctccccaaaggaggaggtcgtggccttcccaaagcgcagtagccacggtggaaacgaaagcgtgccgcataagcctaccgtctaccgcccgcacatcaggaacctcaaggtacttcagggaagcagttaagtcaagccggcgcgtcacaggcactcggcgtgcaagccgccccgcaggtgctaccgtctcttacctccctctacttttaggaaacacgttgtatccccggagggggtgcaccgttcctggaggtactgcaataccaggtcgatgcgtggagtggacggagcaagctcctattccatctccctgctccaaaaatccatttaatatattgtcctcggatagaggacgtatcagatattaaactgataagaacagatactacacttgatcttagccaaaaggccgagaagcgatgcgctcgccttcgcgcccgccgtcaccgtcccactctcatccacattcaagtcgcggtgagagccccagcctcgctccttgccccattccctctgtctcgtccacagcgctattgacgcccttacactctcgggctgatttcttattctccgcctttgaaaagggaaatcttacacccgtgcttcttccggcgttcccgggctttcatttcgaatttgcatgccccgccctttcacagagggcgtggcctccgccgttgactccgcccccggggccgcctctgcctgggggagccggggctccgctgggggcgacttccttgttcgtatcgagccagcgaaaagacagaaccggaagagaccgggggcgaaggcgacaggggtctgtggaagagacctgtcggcggagagcggtccacgttttcctggagaaagacgaggccccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaacgctgcctctctgctcgggacgtggattcctttcccctcctcctcgcctggctacttctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagccattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaaaggggaaggtcgggctcggggtggcaggaccccagagggcaggggtggctgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcagggggtgcccaaccccccgccctaaatcattcagcaatcaacataaattatagttcaacgcaatgtatcttatcttgtgggccgcaagccacccaggtgcccaggcaagagcctgaaggcacaagctgttccagtacagcgaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcgtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtggacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatctagggagccctggaaatgtggtcagttctaatggagctgtgctgtaagtgtgaaatacacgtgggattttgacggcagtgggagcaaaattctcccaattttttttttttttttttttttttcagacggaggttccgctcttgttacccagcctggagtccaatggcgcgatctaggctctctgcaacctccgcctcccgggttcaagcgattcccctgcctcagcctcccgagcagctgggactacaggcatgtgccaccacgcccggctaactttgtatttttagtacagatggggtttctccacgttgctcaggctggtctccaactcccgacctccggtgatctgcccagctgccgcctcccaaagtgttgcttgcgattacaggcttgagccaccgctcaccctggcttttttttttttttttttccagacaaactctcgctctgtcgcccaggctggagtgcagtggcgcgatctcggctcactgcagcctctacctcccgggttccagcgattctcctgcctcagcctcctgggtagctgggattacaggcgcaggccaccacgcccggctaatttttgtatttttagggggtttcgccatgtcggccaggctggtctcgagctcctgacctcaggcgatccgcccgcctcggcctcccaaagcgctgggattacaggcgtaagccaccgcgccgggctctttcattctgtctttattttctgagatagagtctcgctcggacgctcaggttggactgcaacggcgtgatctcggctcgctgaaacttccgcctcccgggttcaagcgattctcctgtctcagcctcccgagtagctgggattattgacgggcagcaccacgcccggctactttttgtggtttttgtatcttctgtcttctgctctttagtaccgcatagagccgcagaagactagcgagtcgaacaaacggcccctcttgcagcagttgttgatcacggggctgccccccggtactcatcctgtgtctctcgtccaaatccccgctcctcctcagctatcacctctgccgatgctggtggtttccctgggtaccgggaaccaaactctcattccccaggggcctaagccccccgtggccaggcccttctcaagtcagggttcctgcacattcacagttacgggtggccctgggagtaacacctggcacccaaacaggtcaccagagtccacacatagtccacctgccctccctgcgtaagatcagctcttcctcctcccgacgatagatcagggtcaatgatccctgccaagatggcgactgctccagcctgctggtccaacctgtccagccacagctgttgctcgaaggcttgaagttcaatgggaccctctcccgctttctacaaactggttcctttatttttatgtttatttatttgggacggggtctggctctgtcacccaggctggagtgcagtggtgcaatcactgctcactgcagcatccacctcccagcgtccacccatcctcctggcctcagcctccggaacagctggggtacaggtacgccccagcccgaacaggttttcactaggttgcctgggctctttctttctttgtctgtgtttgtttgttggttggttggttggttggttggtttttgtttgtttgtttcgagacggggctccggctctgccgccgggggctgcagtgcaatggcgcgatctcacctcactgcggccttctgggctcaagcgatcctcccactgtgcccggcctgaagacagcctttagagaaagaagcagggggagttcttccgaggacagacaagatttctggagtttggaaagggtgagagactgggtcagcgaaaggaacattccggtctttatgttgggatgcaacgtatagatacagggatgagacccaaaagagccggcagaggtttgtcatcgtgctcgcaaggcaactgccggtggctgatcccgtaaaggatacacatacctagagcggagcctaaagatgcatccagcatgacgggtggagccacgatgcttggactcgagctctgctcctgtgcgttccgtgatcaatggcttatactacctgcacctcagtttttcccgggcaaaaaaggaagcttgctgccggtgcgttggcacctgccttaaagtgccagctactcagcgggctgaagaggaagaagttcctactaggaagacacgtggacacgtatgtttactgcagcactatttacaatagcaaagacttggaaccaactcgaatgcccatgaatgataggctggataaagaaagtgtggcacgtatacagcatggaattactacgcagccataaaaaaggatgagttcatgacctctgcgggaacgtggatgaagctggaaggcctcattctcagcaaactgacacaggaagcgaaaaccaaacaccgcatgttctcgctcctaagtgggagttgaacagcgagaacacatgggacacagggaggggaacatcacacgccgggccctgacggggcgtggggggcaaggggagagagagcattaggacaaatagccaacgcatgcggggcttcaaacctagacgactggtggataggtgcagcaaagcaccgtggcacacgtgtacctatgttccaaacctgcacgtcctgcacatgtaccccagaacttgggagggggtgggggaaaccaaaagagcgagggagaggcggggggggggaagagagagagagagggaaagagagagagagacagagagaggagagagagagagagagacagagagagagacagagagacagagacagacacagagagacggagagacagagagagagagagagagaaagagagagagagagagagagacaggagaaagaagaactccgggtgggtcccattcctttaaaaggtcgccacccactcgactgccaagctgagatcctaaggacctccccaaaggaggaggtcgtggccttcccaaagcgcagtagccacggtggaaacgaaagcgtgccgcataagcctaccgtctaccgcccgcacatcaggaacctcaaggtacttcagggaagcagttaagtcaagccggcgcgtcacaggcactcggcgtgcaagccgccccgcaggtgctaccgtctcttacctccctctacttttaggaaacacgttgtatccccggagggggtgcaccgttcctggaagtactgcaataccaggtcgatgcgtggagtggacggagcaagctcctattccatctccctgctccaaaaatccatttaatatattgtcctcggatagaggacgtatcagatattaaactgataagaacagatactacacttgatcttagccaaaaggccgagaagcgatgcgctcgccttcgcgcccgccgtcaccgtcccactctcatccacattcaagtcgcggtgagagccccagcctcgctccttgccccattccctctgtctcgtccacagcgctattgacgcccttacactctcgggctgatttcttattctccgcctttgaaaagggaaatcttacacccgtgcttcttccggcgttcccgggctttcatttcgaatttgcatgccccgccctttcacagagggcgtggcctccgccgttgactccgcccccggggccgcctctgcctgggggagccggggctccgctgggggcgacttccttgttcgtatcgagccagcgaaaagacagaaccggaagagaccgggggcgaaggcgacaggggtctgtggaagagacctgtcggcggagagcggtccacgttttcctggagaaagacgaggccccagggcaggagcgcgggctgcgctgggcctttacttcgccgcccgcgggcggggagaccggccccgtacccgaggggacgaggggacgaggggcccatgcccagtcagggaagccgaaggcctggaggggcttccgggagcaggggctggagttcctctgccaggcaggaggctggcaccagacacccggcagagggaggcggcgagggcccagcaaggattctccccagcccctgtgcctgcgtctcctgcggcttctgtgcgcggaccgtgtcctgtgctgtgtagggaacgctgcctctctgctcgggacgtggattcctttcccctcctcctcgcccggctacttctgacgcaggtcgtcaggactccgcttgggtgtcacccgtgcaggaagcctcccttagtcaagggccctcggcacccgccccatatgtgactagcagccctcctgtgtatttcatcgcgcccccgttgtttatatcagccattccactcaccacccttctgggcaaccctttatctcccgctctgaaatcccatcgctgagggctgggacccctcctcagtgcttatccctgtttccccgcgcgagtctggcgcctggcgtgtggaaggcgctcagtaaacgtttgtggagcgaagaaacgacgcaaaggtgatgagcacgacgcagttaggaggctattggcccggcgcgggggaaaagggggaaggtcgggctcggggtggcaggaccccagagggcaggggtggctgccggggtgctcttggggcaaggtgggcgtcaaggcccccagcaaggttgggataaagttcctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcagggggtgcccacccccccgccctaaatcattcagcaatcaacataaattatagttcaacgcaatgtatcttatcttgtgggccgcaagccacccaggtgcccaggcaagagcctgaaggcacaagctgttccagtacagcgaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgacccgaagacgagagtgtgagccctcattcacgcccagagaagcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccatgcaacattcgaaatgaaagcccgggnaacgccggaaagaacacgggtgtaagatttcccttttcaaggcggagaataagaaatcagcccgagagtgtaagggcgtcaatagcgctgtggacgagacagagggaatggggcaaggagcgaggctggggctctcaccgcgacttgaatgtggatgagagtgggacggtgacggcgggcgcgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccttgaggttcctgatgtgcgggcggtagacggtaggcttatgcggcacgctttcgtttccaccgtggctactgcgctttgggaaggccatgacctcctcctttggggaggtccttaggatctcagcttggcagtcgagtgggtggcgaccttttaaaggaatgggacccacccggagttcttctttctcctgtctctctctctctctctctctctctctctctctttctctctctctctctctgtctctccgtctctctgtgtctgtctctgtctctctgtctctctctctgtctctctctctctctctctctctctctctctcctctctctctgtctctctctctctttccctctctctctctcttcccccccccccgcctctccctcgctcttttggtttcccccaccccctcccaagttctggggtacatgtgcaggacgtgcaggtttggaacataggtacacgtgtgccacggtgctttgctgcacctatccaccagtcgtctaggtttgaagccccgcatgcgttggctatttgtcctaatgctctctctccccttgccccccacgccccgtcagggcccggcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagctggcactttaaggcaggtgccaacgcaccggcagcaagcttccttttttgcccgggaaaaactgaggtgcaggtagtataagccattgatcacggaacgcacaggagcagagctcgagtccaagcatcgtggctccacccgtcatgctggatgcatctttaggctccgctctaggtatgtgtatcctttacgggatcagccaccggcagttgccttgcgagcacgatgacaaacctctgccggctcttttgggtctcatccctgtatctatacgttgcatcccaacataaagaccggaatgttcctttcgctgacccagtctctcaccctttccaaactccagaaatcttgtctgtcctcggaagaactccccctgcttctttctctaaaggctgtcttcaggccgggcacagtgggaggatcgcttgagcccagaaggccgcagtgaggtgagatcgcgccattgcactgcagcccccggcggcagagccggagccccgtctcgaaacaaacaaacaaaaaccaaccaaccaaccaaccaaccaacaaacaaacacagacaaagaaagaaagagcccaggcaacctagtgaaaacctgttcgggctggggcatacctgtaccccagctgttccggaggctgaggccaggaggatgggtggacgctgggaggtggatgctgcagtgagcagtgattgcaccactgcactccagcctgggtgacagagccagaccccgtcccaaataaataaacataaaaataaaggaaccagtttgtagaaagcgggagagggtcccattgaacttcaagccttcgagcaacagctgtggctggacaggttggaccagcaggctggagcagtcgccatcttggcagggatcattgaccctgatctatcgtcgggaggaggaagagctgatcttacgcagggagggcaggtggactatgtgtggactctggtgacctgtttgggtgccaggtgttactcccagggccacccgtaactgtgaatgtgcaggaaccctgacttgagaagggcctggccacggggggcttaggcccctggggaatgagagtttggttcccggtacccagggaaaccaccagcatcggcagaggtgatagctgaggaggagcggggatttggacgagagacacaggatgagtaccggggggcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagtttgtctggaaaaaaaaaaaaaaaaagccagggtgagcggtggctcaagcctgtaatcgcaagcaacactttgggaggcggcagctgggcagatcaccggaggtcgggagttggagaccagcctgagcaacgtggagaaaccccatctgtactaaaaatacaaagttagccgggcgtggtggcacatgcctgtagtcccagctgctcgggaggctgaggcaggggaatcgcttgaacccgggaggcggaggttgcagagagcctagatcgcgccattggactccaggctgggtaacaagagcggaacctccgtctgaaaaaaaaaaaaaaaaaaaaaaattgggagaattttgctcccactgccgtcaaaatcccacgtgtatttcacacttacagcacagctccattagaactgaccacatttccagggctccctagatacctgtggctagcggctgccatactacaccgtgctgggctgtagaatggggatgacaagacagggcggcggagattgtgttggcgtgaagcgagggaaacactcggccgcaggacaaaactaaaacagcaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccccgcgcgggggaaaaggggaaggtcgggctcggggtggcaggaccccagagggcaggggtggctgccggggtgctcttggggcaaggtgggcgtcaaggcccccagcaaggttgggataaagtttctctccgaggcacagactgccgcctgcgggctcagcatttacctctcccttcctccttcctaacgcaacttcagcggagggctgagggctctactgcgcattacctggaaaacttatttcactccacggccctaagaggtgggccttattattagccacggccagggttagggtgaggccactcctccagggcagaatttcaggggggtgcccacccccccgccctaaatcattcagcaatcaacataaattatagttcaacgcaatgtatcttatcttgtgggccgcaagccacccaggtgcccaggcaagagcctgaaggcacaagctgttccagtacagcgaagaaaataattagaataagaaaagttttactagagataggaaacggataggattatatctgactattattaatcattagtttgtagcatcactctttgttctattaccataatgatctctgttctattatgattaccttgggggaaaccaggccacacagagttaggagctgaagggccacagtgagaggtgaccagaagacgagagtgtgagccctcattcacgcccagagaagggccgctggagggctccttggcctagcggtaatgccagtgcctgggaaggccctggttacttagcaggccttggtctagcggtggccccagtgcctgggaaggcacccgttacttagcagacccggaaagggaatctccctctctccaggggagacagagaacgctccgctccaccacctcttgtgggaggtctgacattagccaggccggcccgcagtcatccggaggctccaacgtctgtctccctgtgatgctgtgcttcagtggtcacgctccttgttcactttcatgttcagcctgtacacctggctcctccttttaagttcttagaagacagcagtagcagaactagtaggagtaccacagtcttcgatctttctgataagtgcatagaagaaacgctgacgtttgctgtcctccctctccacctcggctaccacaaagggaaaggccccctgtccagtgcacacgtgactcgcgtgacctatcgatcattggagatgactggcactccttaccctgcccccttgccttgactacaataaatagcagcgcctccaggcactcggggccactacctgtctgtctccgcgctttggtggcagtggtcccccgggcccagctgtctttcttcctatctctttgtcttctgtctttatctcttcgatctctcgtctccgcacacacgcgaagagaaaacccacagacccggtaggggtggaccctacattatctcagctacaacataatcaggatattcacgtggactactgagtctttcggtgcccccttgctgttttagttttgtcctgcggccgagtgtttccctcgcttcacgccaacacaatctccgccgccctgtcttgtcatccccattctacagcccagcacggtgtagtatggcagccgctagccacaggtatctagggagccctggaaatgtggtcagttctaatggagctgcgctgttaagtgtgaaatacacatgggattttgacggcagtgggagcaaaattctcccaattttttttttttttttttttttttttcagacggaggttccgctcttgttacccagcctggagtccaatggcgcgatctaggctctctgcaacctccgcctcccgggttcaagcaattcccctgcctcagcctcccgagcagctgggactacaggcatgtgccaccacgcccggctaagtttgtatttttagtacagatggggtttctccacgttggtcaggctggtctccaactcccgacctccggtgatctgccgagccgccgcctcccaaagtgttgcttgcgattacaggcttaagccaccgctcaccctggctttttttttttttttttttttttttttttttacagacaaactcttgctctgtcgcccaggctggagtgcagtggcgcgatctcggctcactgcagcctctacctcccgggttccagcgattctcctgcctcagcctcctgggtagctgggattacaggcgtaggccaccacgcccagcaaatttttcctatttttagtagagacggcggtctcatcctgttagccaggatggtctccatctcctgacctcgtcatccgcccccctcagcctcccaaagttctcggattacaggcttgagtcaccgtgccctgccttctgtgaggcttttctttccaacatctctctctctttttcttgtctttttcttttcttttctttttttttttttgtgtcggagttttgctcttgattcgcgtgttggagtcgaatggcgcgatctcggctcactgcaacctccacctcccaggtacaagcgattctcctgcctcagcctctggagcagctgggattacagggatgcgccaccacgcccagctaattttgtatttttagtagaggtggggtttcgcaatgttgggcaggctggtctctaactcaggtgatctgcctgcctcgtcctcccaaagtgttgggattacaggtgtgagccaccgtgccggcgattacagaatttctttttttctttctttctttttttttttcgtgatggagtttcgctcctgttgcccaggggagtgcaatggcaggatctcagctcaccccaacctccgcctcctgggttcaggcgattctcctgcctcagcctcctgagcagctgggattacaggcatgtgccaccacacttggctaattttgtatttttagtagagaccaggtttctccatgttgatccggctggtctcaaactcctgacctcaggtgatcctcctgcctcggcctcccaacatgttgggattataggcgtgagccaccacgcctggcggttacagaatttctaagcagcaaacattcaagaggtgactttggtgctgttaaaagcatccaggatttgttgttgtttttgctatttttgtttttttgagatagtctctgttgcccaggctggcatgcagtggcaagatctcggctcactgcaacctctgcccgcagagaatcaagtgattctcgtgcctcagtctcctgagtagctgtgattacatgtgcctgccaccacacccagccaatttttgtatttttattagagatagggtttcaccatgtttgccaggctggtctcaaactcctgatgtgaattgatctgcccacctcagtctcccaaagtggtgggattacaggcatgagccattgtgcccagtagcattctgttcttattttttttttttttttgagacggagtctcgctctgtcgcccaggctggactgactgcagtggcgtgatctcggctcactgcaaccttcacatcctgggttcaaacaattctcctgcctcagcctcccgagtagctgggaccacaggcgcccaccaccacgccaggctaatttttgtatttttagtagagatggggtttcaccatattggcaggcttgtctcaaactcttgacctcgtgatctgcctgcctaggcctcccaaagtgctgggattacagggatgagccaccacatctggccagcattcagttgtaaaagtgaaacagaccaggagcagtggctcatgcctgtagtcccagccctttgggaggctgagttgagcagatcacaaggtcagtagttcaagaccagcctggccaatatagtgaaaccccatctctactaaaaatacaaaaattagcagggtgttgtggtgggctcctgtaatccccactacttgggaggctgaggcagagaactgcttaaacccaggaggcagaggttgcaatgagccaagatcacgccactgcactctggcctgggtgacagagcaagactccattaaaaaaaaaaaaaaaagttaaaatgagcatacaatttcaaaaaatttgcagcctgacaatgcggtagaaaagaaaaacccaggccgggtgcagtgcctgatgcccgtaatcctagtactttgagaggctgaagtgggcagatcatgaagtcaagagattgagaccatcctggccaacctggtgaaactcggtctctactgaaaatacaaaaattagctgggcatggtggcacacacctgtagtcccagctactcgggaggctgaggcaggagaatcgcttgaacccgggaggcggaggttgcaatgagccgagattgtgccagtgcactccagcctggcaacagatcaagactccatctcaaaaaaaaaaaaaaaaaaaaaaaaattcagaggagaaattcaagctggcctcagaaatttgcataagtaacgagaagccaaatgttaatcatgaagacagtggggggaaatgtctccagggtatgtcagagaccttcatgtggcagaccctcccatcacaggcttggaggcctagtaggaaaaaatggtttcatgggctgtgcccagggcccccctgctctgtgcagcctggggacttggtgccttgtatcccagctgctccagccacagctaaaaggggccaaggtgcagctcaggctgtggcttcagagggtgcaaaccctaggccttggcagctttcatgtggtgttgtgcctgcgagtgcacagaagtcaagaattgaggcttgggaacctctgccaagatttcagaggatgtgtagaaatgcctggatgtccaggtagaggtgggctgcaggggtggagccctcatggagaaccactgctagggcagtgcaaagggaaattgtggggtgcaagccctcacacagactcccaactggggcagtgcctagtggagctgcaagaaaagagtcactgtcctccagaccccagaatggtagctccactgacagcttgcaccttgctcctggaaaagccacagacactcaaggcctgcctgtgaaagcagctgggagggggggctataccctgcaaagccacaggggcagagctgccaaggccatgggagcccacctcttgcatcagtgtgacctggacatgagacatggagtcaaaggaaatcattttggggctttaagatttgactgctgccaggcatgtcggctcactcctgtaattccagcactttgggaggccaaggtgggaggatcgcttgagttcaggagttcaagaccagcctggccaacatggtgaaactccgtctctactaaaaatacaaaaaaaattagccaggcattgtggcatgtgcctgtaatcccagctactcaggaggctgaggcagaagaattgcttgaacccgggaggtggaggttgcagtgagccaagatcatgccactgcactccagcctgggtgacagagcaagactccatctcaaaaaaaaaaaaaaaaaaaaaaagatttgactgctccactggacttcagacttgcataggagatctgtaacccctttgttttggccaatttctcccattttgaacagctgtatttactcaatgcctgtaccctcattgtatctaggaattaacaaacttgcttttttttttttctttttgagacagagtctcactctgtcacccaggctggagtgcagtgccatgatcttggctcactgcaacctctgcctcctgggttcaagcgattctcctgcttcggcctctcgagtagctgggattacaggcatgtgccaccacgcccggctaatttttttgtatttttagtagagatggggtttcactatgttggccagactggtctcaaactcccgaactcagatgatctgcctgccttggcctcccaaagtgctgggatcacaggcatgagccaccatgcccgaccctaacttgcttttgattgtacaggctggtaggcggaagggacttgccttgtctcagatgagactttggactgtagacttttgagttaatgctgaaataagactttgggagactgttgggaaggcatgataggttttgaaatgtgaggacatgagatttgggaggggctacagcaaaatgatatggtttggctgtgtccccacccaagtctcatcttgaattgtagctcccataattcccacgtgtcatgggagggacccagtgggaggtaattgaatcatggggccaggacttttccatattgttctcatgatagtgaataagtctcacaagatctgatggttttataaaggggagttcccttgcacaagttctctctcaccttccaccatgtaagacatgcctttcaccttccaccatgattgtgaggcttccccagccacgtggaactgtgagtccattaaacctctttttctttataaattacccagtctccggtatgtttttattagcagcacgagcacagactaatgcagacttattgggccccaggtagcaaatgtgggatgtctattttcccccagcttgcccagggttaaggtgagcccagtcagcttccaccagttacactcagtgacacaggtgcagtttgttagagttggtgcagttagattagttggaggtgggcccaaggactttggggatgcgggttgagggggtggggagtggggtgacaggtaccaaagggtagcagagggagggatggtagaggtgattggagagtgtgaccctcgaagtggatggggttatggcaatcgacaatgacatgacctagggttagaccagggaagtgagtggctggggtagtcaaagctgaggtcaaggaattggggaaccagggtgtcgattgatgacaggagttatgctggagaaagtcagtgctccaggagctaaaaaccttcaaggaataaagtaagtgttggcatggagtgaccagcagccaggagagacaacagcaacaaggagaggtagtgggcagcacaggtgcaaggcacaatggagtgagaggtggggagagcaaacagaaagaggaaagcaatgtcttcagcgggaggatagagcaaacgaagaaaggggggccgggcacagtggctcacacctgtaatcccagcactttgggaggccagtgcgggtggatcacctgagtttggcagtttgagaccagcctgaccatcatggagaaaccccatctctactaaaaatacaaaaaaaatttagccgggcgtggtggcacatgcctgtaatcccagctactctggaggctgaggcaggagaatcgcttgaacccaggaggtggaggttgcagtgagccgagatcgcaccattgcactccagcctaggcaacaagagtgaaactcagcctcaaaaaaaaaaaaaaaagaagaagaagaagaagaagaagaaaggaggctgggaatagggaggatggtaggaaaattagcaaggtttcaggaatcagacatgggataagagaccggagcttcttgtgactggcgggcatagggcagaaatgcagaactgtgggatcgttctacagtgagtggcagatacctggaaggcagctgcagccttaggtcttggctctcactaattgggtgatgtcacctctgtccaagcagtcgatcccaggagcctccgaagaccaccagagcagtccttagtgccaggtgagtctgctaaaataaaaacacaacgctttgccgagaagcggggtaaaaaaaagctttatcgccggctgcaatcgaatttcggggacaggccgggtgcagtaactcaggcctgtaatcccagcactttgggaggcccaaacgggtggatcactttgaggccaggcgttcgagaccaacctggccaacatggcaaaaccccgtctctactaaaaatgcaaaaaattagccagtcatggtgggcacgtgcctgtaatcccagctactcaggaggctgaggcacaagaatcacctgaacttgggaggcagaggttgcagtaagcccagatctggccactgcactccagccggggttgggggttgtgggggacagagtgagactatcttaaaaaaaaaaaaaaaaaaaaaaaaaaaaaaaaggaagtggagactagccacagacccaaaagaaaacgagcaaaaatgtaaagcctacttttggcaattgctcatgtggagaggaatgaatgcagtgttcttgaaattattgaaatattagatccggaagctgaagtgggagaaccatctgagtccaggaagtcgagatcatagtgaactctcatcccgccactgcactccagcctggatgacaaaagtgacactctataagacaaaaaaaaaaaaaaaaaaaggcggggagggggctggtcacacatactctcacctagacaaggatattgacgaccaattctgaagcatgatataacgcaataagaacgtgaatataacaaagtataacctttaaaacacaacgctcactcacctaaaaaatcgttcacctttgtttgaagtactacaacctcccaaccccaccgttttctccaaaaaccccctcaacacagcattctcagaaacaaaaagaaagaacgcacacactaagctaggaaaaacacacataattacacctcaccacaaacagagatctggaaaaatttgtcgaatccagcatctttgccttcgccattaccaccctcatatcaccatattacacccacggtgagcaacgataggggcaattgacaacttcgtttctcaataggcctgttgaaaacagcaagcctttgggcatggtttatagttggctacgttttcaagtgaattctcagctctgtttttgccccgtggctgaagcgccatttctaatttgcatgtctcgccctttcccgcgtgggtaggcgtggctacggcgatctgagtccccgctgcggtccagctctgctcgcagcggccggccgaagctgggctggggctcccggtctggaccatccgggggtcaagacagtggtcagggggaaatgcgcgtgggcgtcactagcggtctgtggaagggagttggaggagagtggtccgagctcttttgaggaaagccatcaggtcatcactgtaaagactggagcgtcccgcggcctggctgggtcccaagcgaaggcggagccgacgaggccccgccgccccccacccccttcccggggccacagagagaagtcgggtcgcgagaccgcgccgagggggctgccgccctgggagtcacagccccgtccgcgcgccttgccctgtcggcggggcactgggggcaaaccacttaacctccggactctgtttccccagctggaaagcagaaacaccaatgcctacctcgtggggtggagggagcagaaacggagccgaggaagggaccgtggctcggtagtctgcaatgtgagtcagagtttcccacaagcttccccagaaggggtcatgactgtgaaatgactgagacaataaaataggaagcatttactgtttggcttaggctctgtgttaagtgctctcctcattacaaacttgcaaaagttacatacagatgcagaagctgaggcagagaggttaagcagcttgcccaagaccacagggaggtaggatttgaacctaggtgcactggccacagcatcttccccatcactccatccacctgtgaagcagagagcctagagccaaaaatggatacctagagaaagataatttgttcttgtgtgtccagcactctgtgagacaaagcactgagcctgagacacaagtcttctgtctgcagagaggcaagaaccaagctgtctgctgcagcagttgagaagagcctcggccctggcactgtggctcatgcctgtaatcccaacactttgggaggccgaaatgggaggatcacttgagcccaggagttcgagaccagccttgacaacaaagtgagagccccatctctacaaaaaaaaaaaaaaaaaaaaaaccagaaaatctaccgggcgtggtggagcaggcttgtagtcccagtgactggggagactgagcttgggggactacttgagccctgggaggaccacttgagccctgggaaaacagcttgagccccaggaggccaaagtggcaatgagctgtgatcaggccactgcactccactccaacctgggggaccgactgagaccctatctcaaaaaaaaaaaaaaaaaaaaaaaaacccctttgccaggcaggggggctcacacctgtaatcccagtactttgggaggcctaggcgggcagatcatttgaggtcaggagttcgagactggcctggccaacatggtgaaacctcctctctcccaaaaatacaaaaaattagccaggcgtggtggtgggcacctgtaatcccagctacttggggggctgaggtgggagaatcgcttgaacccagaggcggaggctgtagtcagccacaatggcaccattgcactccagcctgggagacagagcaagactccgtctcaaaaaaaaaaaaaaaaaaaaaaaagtcgggcatggttggtgggtgcctgtaatcccagctaatcgggaggctgaagcaggagaattgcttgagcctgggaggtggagattgcaatgagccaagaccatgccacccactgcactccagcctgggcaactgagcgagacgccgtatcaaaaaaaaaaaaaaaaaaaaaaaaaagcaagggaaaacagcttaggcaagtcactcctctgaggcttattttttttcctgtataaaacaggaatcttaaaatctagtctgtagtcctggcgttctctaccctcatccacacagggtctctgttctcttttacctggctttattctactcggtggcacctgtcaccccacattttatacaatgatacgtttattgcattttagcatagtagaatgtaagctccagagcaggaatctttgtcgcttgttcacttttatatgactggcaccctgaacaatgcctggcatatagtagccactcagtatatattttttgaatgaatgaatgaatattaaatatattaatatttcctacaatagaaagtgattagtaaatctcctggcttgtggtaagtatcatgaccctgcagggctcactattttactgcctctctgctcattttcgtgtttatcaggccatcttttgcttgctaatttggtttcccaggtactgttttttgtttttttattttagtagagatgggttctctctatgttgcccaggctgatctcaaactcctgagctcaagcaatcatccttcctcagcctcccaaagtcctggggttacaggcatcagccatcattcccagtccccggtattgtttttgagtacttaggggagccaaggggaaacttccgtctttgccctgtgaaggttcagtgaaaaatcactggcacgaggcagattaacaggagaaaaggcatataattttgtttttaatggtatacatgagagtcttcagagcaaagacccaaagatacagagaaaattgtccgttttaatgcttagggtcaataaagtatggaaggccatgtagaaatatgactggacaagaggacatgctgtaaggagaatacaatgagtggggaaatccctaaggctcctgtctgtccaggttttattttattttttttcccaacacagtctcactctattgcccaaaccggagtgcagtggcgtgatcatagctcacggtaacctcaaactcctgggctcaagagatcctcccatctcaacctcctaagtagctaggactacaggtgtgtgccaccacacccagctaagttttttaagtttttaattttttgtagaaacagtgtcttgctggccgggcgcagtggctcacgcctgtaatcccagcactttgggaggccaaggtgggcggattacagggtcaggagatcgagaccatcctggctaacatggtgaaaccctgtctctactaaacatacaaaaaaattagccgggcgcggtggtgggcacctgtagtcccagctacttgggaggctgaggcaggacaatggcgtgaacccaggaggcggaggttgcagtgagccaagatcgcgccactgcactccagcctgggcgacagagcgagactccgtctcaaaaaaaaaaaaaaaagaaaggaacagtgtcttgctatgttgccttttgagactcaaagtggaaatttcttgaagcctttttcatctctttgtcttcagccacactttccatgacgagctgttgctgtctgtcactttctcctttagacttttgccagatagaggatcttgaactcctggcctcaagcgatcctcctgcctcagcctcccacagtgtgggaattacaggcgtgggccaccatgcctggcctgtccagatccttgttggcttctctgagcatgtattccttccttctgcgtgtcgggcaggatgctctgtggaatgggggtcttatgacctacagtcaaacaaagtaggtcaggtaatttctttgtggccagtttttacagataggacagagggaaaaccagagtaatatttttacacttgcaggctggctttggagaaaagggcttctggtttccatgacctgcctcagggaagagggatttttgtgtctatggctagcttcaggggagaatgggactgggggagtcagagaaaaactttttacttctgaggctgctgctgaggccttcattttagggtattgttttctgagcccactgtatgccactgagtatctacattttcttttcggtgtttcaacaatcccaaatgcagccaggtgcggtggcttacccttgtaatcccagcactttgggaggccaaagtaggaggatcacttgagcctaggagtttgagaccaggttgggcaacatagtgagacctcatctctacaaataataataataaaaataaggccaggtacagtggttcacacctataatcctagcactttgggaggccaaggcaggaggaccacttaagctcaggagttcaagaccagcctgggcaacatagtgagacctcatctctattaaaaatagtaataataggccgggcgcggtggctcacgcctgtaatcccagcactttgggaggccgaggtgggcggatcacgaggtcaggagatcgagaccatcctggctaacatggtgaaaccccgtctctactaaaaatacaaaaaattaactgggcgtagtggcgggcgcctgtagtcccagctactccggaggctgaggcaggagaatggcgtgaacccgggaggcggagcttgcagtgagctgagattgcgccactgcactccagcctgggcgacagagccagactctgtctcaaaaaaaaaaatagtaataataaataaaataagataaaataaaagttagctgggcatggtagtgcatgcctgtggtgccagcaacttgggaggctgaggcaagagcatcacctgagcccaggaggtcaaggctgcagcaagatgtgactggaccagcacactccaggctgggcgacagaaaaaaaaaaatcccaaatgcaacatgttatttatcccattttatacttgatgaaattgaggctgcctagactgacttcccaaaatcctcagccttctgcttcctcctcccagagtataaaagggacccccacttttggctggcaattttatatctttatgatcagtggatctttattctcatccaccttagaggaaagtgggtcagggtttataatctccattgaacagatgagaaggctgagtttcaggaaggaaattcgagctaaccaaattttccaagagactgacttacctctgtgatacatattgaagaaggtggaaacctgaatgctgaggatggaatgtgaagagcctggcacaatgattaagatcacaagagggcccatgtggagtggctcatgcctgtaatcccagcagcactttgggaggcccaggtgggaggatcacttgagcccaggagtttgagaccagcctgggcaacacagtgagaccccatctttttttttttttttttgagacggagtcttgctcggtcgcccaggctggactgcagtggcgcaatctcggctcactgcaacctccacctcccgggttcacgccattctcctgcctcagcctcctgagtagctgggactacaggcgcccaccaccacacctggctaattttttgtatttttagtagagacggggtttcaccatgttagccaggatggtctcgatctcctgacctcgtgatccgcccacctcagcctcccaaagagctgggattataggtgtgagccaccgcgcccagccagtgagaccccatctctacaaaaaacaaaaatattagccaggtgtagtggcacacacctgtagtcctacctactcaggaggctgagatgggagaatcgcttgagtccaggcatttgaggttacagtgagctgtgatcacgttactgctctccatcctggacaacagagcgagacgctgtctcaaaaaaaaaaaaaaaatcacaaggttattggatatcagggatcagcttgctgcactttaccacctctaggagcgctgggtcatccccaagatccgattctctccttgcagtagcagggggcagcagagagcagcaaagcagcccttgcctctcagtttgttatgacctcccagcaggccagaggaaacatccattctgtgcttatttggtttatgagaaaattcaggcccagagagggaaagttcagggtcttccaggtgatggatgacaccaaggctcaaggcccaggcttccaagtgaccacactccatgatggtgcctgctttcacttttttttttttttttttgagacaggatcctgctctgtccccagggatcaagcaatccttctacctcagcctcctgggaagtgagaagctgagactacaggtatgcgccaccacacctgactactttttaaattttttgtcaagacagggatttccctatgttgcccaggctggtcttgaactcctgcctcaaatgatctaccactttggtcttccaaagtgctgagattacaggtgtgagctaccacgcctggatgatttcattcattcagagggcacatttttgttccatatttttagacctcagaaaccaggatgcatcttacatccagtgccaggaaaaagcactacagctgtttaaatgtcagcatcttttttttttttctcctttcttcctttctttctgaggggtacataaaataatggtgcctctcacaatccatgacatcctaaacgtcatgaaatactacaataaaagcctctgtttatctctgtttattaaaccctgtgcttgacaatggattactctttttttttttctttgagacaaagacttgctctgtcgcccaagctggactgtagtggcgccatctccctcggctcactgcaacctccacttctgggattcaagcaattctcctacctcagcctcctgagtagctgggattacaggcagcagccaccatacccagctaatttttgtatttttagtagagacggggtttcgccatattggccaggctggtcttgaactcctgacctcaggtgatctgcctgcctcggcgtctcaaagtgctgggattacaggtgttagctaatgtacctggccggattacttcttttaatataccaatacctccaggatggaggtattattaccccattttgctggtgagtgaactgataatagaggtagagcaattgatcatatctgtacaattaataatggagatgattttttttgttttttgtttttgagacagagttttgctcttgttgcccagactggagtgcaatggcgcaatctcagctcaccgcaacctccacctcttgggttcaagcgattctcctgcctcagcctctcgagtagctgggattgcaggcatgtgccaccacgcccggctaattttgtatttttagtagagatggggtttctccatattgatcaggctggtctcgaactcccgacctcaggtgatccgcccgcctcggcctcccaaagtgctgggattacaggcatgagccactacgcctggccttatttttttttttttaagactgagtcacactctattgctcaggctacagtgcagtggcatgatctcagctcactgcaacctctgcctcctggtttcaagcaattctcctgcctcagcctccagagtagctgggattacaagcgcctgccaccatgcccagctaatttttttttgtaactttagtagacagcatttcaccatattggccaggatggtcccaaactcctgaccttaagtgattcacctgcctcggcctcccaaagtgctaggattacaggcatgagccaccatgaccggctgattttttcttgttttttttttttgttttgttttgtttttttctgagacagagtcttgctctgttgcccaggctggagtgcagcgtgcaatatcggctcactgcaacatctgcttcccaggttcaagcgattctcctgcctcagcctcctgagtagctgggattacaggcgctggccaccatgccaagctcattttttaattattagtagagatggggtttcaccatgttggacaggctggtcccgaactcctgacctcaagtgatctgcccgccttggcctcccaaagtgctgggattacaggcgtaggctaccgtgcccggccttgcagctgatatttcacaggacttatctgcttgtgcttctgtgtgtgtgtgtgtgtgtgtgtgtgtgtgtgtgtgtgtgtgtgtgtgtgtgtgtttgagatggagttttgctctttcgcccaggctggagtgcagtggcgccatctcggccgaccacaacctctgcctcccacattcaagcgattctcctgcctcagcctcttgagtagctgggattacaggcgcccgccagcacgcccagctaatttttttgtatttttagtagagacggggggtttcagtagagacggggtttttcagtagagacggggggtttttagtagagacggggggtttagtagagacggggtttcactatgttggcctggctggtcttgatctcttgaccttaggtgatccacctgccttggcctcccaaagtgctggaattacaggcgtgagccaccatgcccggccctgcttgtgcttctaaccacactttgcttcttccaaaacagaagattctgggtcttgaataacaacaaacttgctttattttttgtagagatgggggttgggaaatggtggggtgggcatgccagttgatatgtcgtgtctatgttgcccaggctagtctggaactcctgggctccaacaatcttcccaccttcacctccaaaagtgctgggattacacgcatgagccaatgtcccagcctacaggctttatttgtttgtttgtttgtttgtttgacagagtcttgctctgtcacccaggttggagtacagtggtgcaatcttggctcacagcaacctccacctcctgggttcaagcgattctcctgcctcagcctcccaagtagctgggattacaggcggccgccaccatgcccggctaatttttttttttttttttttctgagatggagtcttgctctgtcacctaggctggagtgcagtggcgctatctcggctcactgcaacctccgcctcccaggttcaagcaattcttctgcttcagcctcctgagtagctgggactacaggcatgtgccaccacactcggctaattttttgtatttttagcagaaacggggtttcaccatgttagccaggatggtcttgatctcctgacctcatgatctgcccaccttggcctcccagtgtgctgggattaccacctcgcccagccactttgggtgatcttaaatgcacagtcccaggccaggcgtggtggctcgcgcctgtaatcccagcactttgggaggccgaggcgggcggatcacttgcaggacttgcttgaaccagggtggcggaggttgcggtgagccaagatcatgccattgcactccagcctgggcaacaagagtgaaactccgtctcaaaaaacaaaaaatacaataaaaataaaatttaaaaattaaaaaattaaatgcacagtctctatccccaaaagccttcctgggcttcagagaataatcctctcacctgttcactccacctactgaggacacagtccttggaagggtcaggtaggataataataccaacctgtagctaaacaattttatactttatcttttatttcccatccattattctatttgatccttataccagctatgtgaaagaaggtaacaagttatcacttattcttcaggcaaggaaactgaggtccagacagattagggagggtctccaggattataggaagaggtggggtgaggccccaggtgggggtggggacagacagagcccactgctcccaccacctctgtctcttcccactcagacccctctgcctataactggaaccacctcacaatgtggttactgccagggcaactgggcaggccccgcctgctttgttgagggagggaggcatttttcccaaggctcccagggaacatctgcaaagtacctttctctcctgggtcctgatcagatagaagaccttcccaccttagctttgagtctcagtgggccccatggacaattcagcagtaaagtcttttctctctggcttctttcccccactcttcctcagaggctttttagtacagatggggtttctccatgttggtcaggctggtctccaactcccaacctctggtgatccgcctgcctgccgcctcccaaagtgctgggattacaggtgtgagccactggcccaagcttttttttttttttttttttttgagacggagtctcactctgtcgctgaggctggagtgcagtggcgcatctcggctcactgcaagctccacctcctgggttcgcgccattcttctgcctcagcctcccaagtagctgagacgacaggcacctgccaccacgtctggctaatttttttgtacttttagtagagacggggattcaccgtgttagccaggatggtctcgatctcctgacctcatgatctgcccgcctcagcctcccaaagtgctgggattacaggcatgagccaccgcgcccatgcttttttttttttttttttttcagagacaaagtcttgctctgtcacccaggctggagtgcagtggcgcgatctcggctcactgcagcctctgcctcccgggttccagtgattctcctgcctcagcctccttgggtagctgggattacaggtgttcgccaccacgcccagctaatttttgtatttttaaggaggtctcgccaagttggccaggctggtctcgaactcctgacttcaggtgatctgcccgcctcggcctcccaaagcgctgggattacaggcgtgagccactgcgctgggcactttaattctgtctttactttctgagatagtctcgctcggacgctcaggttggactgcaatggcgtgatctcagctcgctgaaacttccacctcccggattcaagcgattctcccgtctcagcctcccgagtagctgggattattgacgcgcagcaccacgcccggctaatttttgtggtttttgtatcttctgtcttctgctctttagtaccgcatagagccacagaagactagtgagtcgaacaaacggcccctcttgcagcagttgttgatcacagggctgcccccggtactcatcctgtgtctctcgtccaaatccccgctcctccccagctatcacctctgccgatgctggtggtttccctgggtaccgggaaccaaactctcattccccaggaacctaagtcagggttcctgcacattcacagttatgggtggccctgggagtaacacctggcacccaaacagatcaccagagtccacacatagtccacctgccctccctgcataagatcagctcttcttcctcccgatgatagatcagggtcaatgatccctgccaagatggcgactgctccagcctgctggtccaacctgtccagccacagctgtagcttgaaggcttgaagttcaatgggaccctctcctgctttctacaaactggttcctttatttttatttatttgggacggggtctggctctgtcacccaggctggagtgcagtggtgcaatcactgctcactgcagcatccacctcccagcatccatccaccctcctgcctcagcctctggaatagctggggtacagataggccgcagcccgaacagggtttcactaggttgcctaggctctttctttttgtttgcttgaacccaggaggcagaggccactgtgcccagccacttggggtgatcttaaatgcacagtcccaggctgggcgtggtggctcacacctgtaatcccagcactttgggaggctgaggcgggcggatcacctgaggtctggagtttgagatcagcctgaccaacgtggagaaaccctgtctctactaaaaatacaaaaattatccgggcatggtggtgcatgcctgtaatcctagctacttgggaggctgaggtaggagaatctcttgaacctgggaggcggaggttgcagtgagccgagattgcgccattgcactccagcctgggcaacaagagtgaaactccatctcaaaaaataaaaaataaaatgaaaataaaattaagaggtagacgctaggcttgagtccagaattagaaatctccagagctagggtgttttctaagaagcccctttgcgttctgggggctcagacctcagtgaggcttagtaggattttgtattttctttcattctgactcagcacagacatttatgggggagatggagagaggagagattaaggagaaaaaggtaattccggagacctaagtggggagagatgagcagaggaagggtcagatgatgatgctggaaccctctgaggaagaatgggggaaagaagccagagagaaaagactttactgctgaattgtccatggggcccattgagactcaaagctaaggtgggaaggtcttctatctgatcaggacccaggagagaaaggtactttgcagatgttccctgggagccttgggaaaaatgcctccctctctcaacaaagcaggcggggcctgcccagttgccctggcagtaaccacattgtgaggtggttccagttataggcagaggggtctgagtgggaagagacagaggtggtgggagcagtgggctctgcctgtccccacccccacctggggcctcataccatcccactatcatgggtagtgcctaccactgggaggcccggcgccggcagatggctttggaccgaaggagatggctgatggcccagcagcagcaggagctgcagcagaaagaacaggtgcatgggataggctgggttcttcagggtcctctctggagcaggaagggaatggagaatggagagagatccctaggaagctgcctactatttggtgaatgctgtttgctgggggtaggaggaaagcaaggtcatttggcgttctctcagatagactgtgtctgtgttggggggaccactatcagctgactcaatttccctcttgtaatagtctaggggaaggcaagggtactaggcctgggaggtttaaagatgttctgtccaatagggtaacccccagcctgtatgctatattgagccttggagtgtgactgaggaaccaaatttttttttttttttttgagatggagttttgctcttgttgcccaggctggagtgcaatggtgcaatcttggctcaccacaacctctgcctcccgggttcaagtgattctcctgcctcagcctcccgagtagctggtattacaggcatgcgccaccacgcccagataattttgtatttttagtagagacacggtttctccatgttggtgaggctggtctcaaactcccgacctcaggtgatccacccaactcagcctcccaaagtgctgggattgcaggcatgagccatgatgcccggtcagtgttatataaatttaatttagtttttaaaaatgttattttggccgggcatggtggctcacacctgtaatccagcactttgggaggccaaggtgggtggatcagttgaggtcaggagttcaagaccagcctggccaacatggcgaaacctggtctctactaaaagtacaaaaagtagctaggcatggtggcgcttgcctggaattccagctacctggggagactgaggcatgagaatcacttgaatcagtgaggtggaggttgcagtgagccaagatagtgccactgcactctgacctgagtgatagagtgagactcttgtctcaaaaaaaaattaaaaactttatttgattttattattgtaatacagacagggtctcactatgttgccctggctggtctggaactcctggactcaagcaatcctcccacctaagtctcccaaaatgttgacaagtgtgaaccaccatgcctggcctttaattaattaattcacttatttattttattttatttttttgagatggagtcttgctccagtcttgctcccagccgggcacagtggctcacactctgtctctcctggagagagggagattccctttccgggtctgctaagtaacgggtgccttcccaggcactggggccaccgctagaccaaggcctgctaagtaaccagggccttcccaggcactggcattaccgctaggccaaggagccctccagcggcccttctctgggcgtgaatgagggctcacactctcgtcttctggtcacctctcactgtggcccttcagctcctaactctgtgtggcctggtttcccccaaggtaatcataatagaacagagatcattatggtaatagaacaaagagtgatgctacaaactaatgattaataatagtcagatataatcctatccgtttcctatctctagtaaaacttttcttattctaattattttcttcgctgtactggaacagcttgtgccttcaggctcttgcctgggcacctgggtggcttgcggcccacaagataagatacattgcgttgaactataatttatgttgattgctgaatgatttagggcgggggggtgggcaccccctgaaattctgccctggaggagtggcctcaccctaaccctggccgtggctaataataaggcccacctcttagggccgtggagtgaaataagttttccaggtaatgcgcagtagagccctcagccctccgctgaagttgcgttaggaaggaggaagggagaggtaaatgctgagcccgcaggcggcagtctgtgcctcggagagaaactttatcccaaccttgctgggggccttgacgcccaccttgccccaagagcaccccggcagccacccctgccctctggggtcctgccaccccgagcccgaccttcccccttttcccccgcgccgggccaatagcctcctaactgcgtcgtgctcatcacctttgcgtcgtttcttcgctccacaaacgtttactgagcgccttccacacgccaggcgccagactcgcgcggggaaacagggataagcactgaggaggggtcccagccctcagcgatgggatttcagagcgggagataaagggttgcccagaagggtggtgagtggaatggctgatataaacaacgggggcgcgatgaaatacacaggagggctgctagtcacatatggggcaggtgccgagggcccttgactaagggaggcttcctgcacgggtgacacccaagcggagtcctgacgacctgcgtcagaagtagccgggcgaggaggaggggaaaggaatccacgtcccgagcagagaggcagcgttccctacacagcacaggacacggtccgcgcacagaagccgcaggagacgcaggcacaggggctggggagaatccttgctgggccctcgccgcctccctctgccgggtgtctggtgccagcctcctgcctggcagaggaactccagcccctgctcccggaagcccctccaggccttcggcttccctgactgggcatgggcccctcgtcccctcgtcccctcgggtacggggccggtctccccgcccgcgggcggcgaagtaaaggcccagcgcagcccgcgctcctgccctggggcctcgtctttctccaggaaaacgtggaccgctctccgccgacaggtctcttccacagacccctgtcgccttcgcccccggtctcttccggttctgtcttttcgctggctcgatacgaacaaggaagtcgcccccagcggagccccggctcccccaggcagaggcggccccgggggcggagtcaacggcggaggccacgccctctgtgaaagggcggggcatgcaaattcgaaatgaaagcccgggaacgccggaagaagcacgggtgtaagatttcccttttcaaaggcggagaataagaaatcagcccgagagtgtaagggcgtcaatagcgctgtggacgagacagagggaatggggcaaggagcgaggctggggctctcaccgcgacttgaatgtggatgagagtgggacggtgacggcgggcgcgaaggcgagcgcatcgcttctcggccttttggctaagatcaagtgtagtatctgttcttatcagtttaatatctgatacgtcctctatccgaggacaatatattaaatggatttttggagcagggagatggaataggagcttgctccgtccactccacgcatcgacctggtattgcagtacctccaggaacggtgcaccccctccggggatacaacgtgtttcctaaaagtagagggaggtaagagacggtagcacctgcggggcggcttgcacgccgagtgcctgtgacgcgccggcttgacttaactgcttccctgaagtaccgtgaggttcctgatgtgcgggcggtagacggtaggcttatgtggcacgctttcgtttccaccgtggctactgcgctttgggaaggccacgacctcctcctttggggaggtccttaggatctcagcttggcagtcgagtgggtggcgaccttttaaaggaatgggacccacccggagttcttctttctcctgtctctctctctctctctctctttctctctctctctctctgtctctccgtctctctgtgtctgtctctgtctctctgtctctctctctgtctctctctctctctctctctctctcactctctctctcctctctctgtctctctctctctttccctctctctctctctttcccccccccgcctctccctcgctcttttggtttcccccaccccctcccaagttctggggtacatgtgcaggacgtgcaggtttggaacataggtacacgtgtgccacggtgctttgctgcacctatccaccagtcgtctaggtttgaagccccgcatgcgttggctatttgtcctaatgctctctctccccttgccccccacgccccgtcagggcccggcgtgtgatgttcccctccctgtgtcccatgtgttctcgctgttcaactcccacttaggagcgagaacatgcggtgtttggttttcgcttcctgtgtcagtttgctgagaatgaggccttccagcttcatccacgttcccgcagaggtcatgaactcatccttttttatggctgcgtagtaattccatgctgtatacgtgccacactttctttatccagcctatcattcatgggcattcgagttggttccaagtctttgctattgtaaatagtgctgcagtaaacatacgtgtccacgtgtcttcctagtaggaacttcttcctcttcagcccgctgagtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatgagtaccggggggcagccccgtgatcaacaactgctgcaagaggggccgtttgttcgactcgctagtcttctgcggctctatgcggtactaaagagcagaagacagaagatacaaaaaccacaaaaagtagccgggcgtggtgctgcccgtcaataatcccagctactcgggaggctgagacaggagaatcgcttgaacccgggaggcggaagtttcagcgagccgagatcacgccgttgcagtccaacctgagcgtccgagcgagactctatctcagaaaataaagacagaatgaaagagcccggcgcggtggcttacgcctgtaatcccagcgctttgggaggccgaggcgggcggatcgcctgaggtcaggagctcgagaccagcctggccgacatggcgaaaccccctaaaaatacaaaaattagccgggcgtggtggcctgcgcctgtaatcccagctacccaggaggctgaggcaggagaatcgctggaacccgggaggtagaggctgcagtgagccgagatcgcgccactgcactccagcctgggcgacagagcgagagtttgtctggaaaaaaaaaaaaaaaagccagggtgagcggtggctcaagcctgtaatcgcaagcaacactttgggaggcggcagctgggcagatcaccggaggtcgggagttggagaccagcctgagcaacgtggagaaaccccatctgtactaaaaatacaaagttagccgggcgtggtggcacatgcctgtagtcccagctgctcgggaggctgaggcaggggaatcgcttgaacccgggaggcggaggttgcagagagcctagatcgcgccattggactccaggctgggtaacaagagcggaacctccgtctgaaaaaaaaaaaaaaaaaaaaaaaaaattgggagaattttgctcccactgccgtcaaaatcccatgtgtatttcacacttaacagcgcagctccattagaactgaccacatttccagggctccctagatacctgtggctagcggctgccatactacaccgtgctgggctgtagaatggggatgacaagacagggcggcggagattgtgttggcgtgaagcgagggaaacactcggccgcaggacaaaactaaaacagcaagggggcaccgaaagactcagtagtccacgtgaatatcctgattatgttgtagctgagataatgtagggtccacccctaccgggtctgtgggttttctcttcgcgtgtgtgcggagacgagagatcgaagagataaagacagaagacaaagagataggaagaaagacagctgggcccgggggaccactgccaccaaagcgcggagacagacaggtagtggccccgagtgcctggaggcgctgctatttattgtagtcaaggcaagggggcagggtaaggagtgccagtcatctccaatgatcgataggtcacgcgagtcacgtgtccactggacagggggcctttccctttgtggtagccgaggtggagagggaggacagcaaacgtcagcgtttcttctatgcacttatcagaaagatcgaagactgtggtactcctactagttctgctactgctgtcttctaagaacttaaaaggaggagccaggtgtacaggctgaacatgaaagtgaacaaggagcgtgaccactgaagcacagcatcacagggagacagacgttggagcctccggatgactgcgggccggcctggctaatgtcagacctcccacaagaggtggtggagcggagcgttctctgtctcccctggagagagggagattccctttccgggtctgctaagtaacgggtgccttcccaggcactggggccaccgctagaccaaggcctgctaagtaaccagggccttcccaggcactggcattaccgctagaccaaagtgttctaaataacaggtgccttccgaggaagaggcactaccacaagaccatggagccctcaagcagccgttatccgggcatgacagagggctcatactcttgtcttctggttacctctcacattgtcccctctacttcttactctgtatggcctgttttttcctcggttataataacaaagattaatactaaaaactaataattgataatatccatatgtaatcatctctgtatcctatgtctgatataactttcttttatcctattttctttattatattggaacagcttctgcgttcagtgtcttgccttggcatctggatggctttctgtagggtgcagccctacagggcctgtgggtttttctgtatgtgtgcggagacaatagatcatggaaataaaaacaccggacaaagagatagtagaaaacacagctgggcccacgggaacactaccacgaaaactcggagaccggtagtggccctgaaggcctagctacgctgttatttattgtatacaaggcaagggggcatggtaaggagtgcgagtcatggccaatgataggtaagggcacgcgagtcatgcatccactgtacagggggcccttccctgtttggtagccgaggcagagacagagaggggagagcttacgtcattatttcttctttgcatttcttgggaagatcaaagactctaatactttcactaattgtgctgctgctatccagaaggcggggccatgtgcacagagcggaaaatgaaagtggaccaggaccactgaagcacagcatcacagggagacgtttaggtctccggatgcctgcaggcatggttgcaggcgggtctgactaatgtcaggccttccacaagaggtggtggagcagagtcttctcttactccgcagggaaaggcagagtccctttcctggtctgctaagtaacgggtgccttcccagacactggcgttaccgcttcaccaaggagccctcctagtggccctgcccgggcatgacagagggctcacactcttgtcttctggtcacttctcaccatgttccttcagctcctatctctgtatggcctagattttcctaggttataattgtagaacagagattattatattggaataaagagtaatgctacaaactgattaataatattcacatataatcacatataatcctatctatattctatttctagtatgactattcttattctaaatattttctttattatactggaacagctcgtgctctccgtctcttgccttgggacgtcggtggcttaccacccacatctccccactttttattgactaggatcatcattgccatcattgcttgtcgttgacttgggacttgtcctcggcctccttggagacatctgcagactaaaagtagacaacataaacataccagtattaataatgccaatgacaacgatgatcctccgaggggtttgatccatttaaagggattaagatcagataatcctttagttattccttcaaaactgcccaaggcaggagcagtagttaaatgagcctgtgaggcctcaaaaacgtgttctttaggttttgaaatatctaaggttaagttatcatcccaggcttttaaatgtcttgagacttcttccccactatgttgatctttattataaacataaggttttatgcaataatcagaagtattccaatcgcactgtaattgcatatggtgttccagattcataactctatctcccagtcagattacactctggtggagataattaatttgattagccaatttttgatcaacttgagcatgagaatttcagagtttggtggagttttttttgccatgcttccacatattgagcggtttgaacagagttgtggatagcaactccaacggttgtcgctgttgcagtaatggcaattagtcctgcaatgactgcaataagagtaaaaatgaatctcttggttcttttgaggatacccttaagaagttcactgactatgtgtatagagggggaagacttccatggatgatgtaaagaaattatatccatacccccttcctagcccttatcaaaagaatacttgttctgggattaaaagtagcatcgatacacgtgaacagcttacaatcattacattctatagtttgtgtattgggagtaataattataattccaactagcagcatgtaaggggatttgacacagctcctgatatgtatcacctgtcctgacatcaaggtgatcttgaatatgagtgtcttggtattagtaggagagatttgataggtagcgttccatatccttattcctgtcatggctgcagctaatttccctaattcaggatgttcaggggtaacaatttgatgaatcatttttggtctaggaggaacgattcctgtgttcctccatttgaatggataaggggcacccattccctcaacctgtagaattgccatcagtcctttacataatctaacaaataattaaactccaagcatttggcattttagccagagcaatttctccaataataccctcttggggcccagtcaataacagcacccatagctagattttggaacactacggcctttggagcattacaatcattccataaaattgaatttagtagaaaatgtccctttgtaggttcctttgagcagtctggcaatccttttgttttattgcttttagtagtgacaggaactctccattcctcatgtggattaagtttaacattcatgagttgaaaagaattgctcctgcacttgataagaatcattactagaggactgtatggtccacatcgaattctgataagaataagctaagcagccaggcaacattccaatacacagtggtggatatttgtagccaattgacaaattaaagtgcataccttttacttctggttgagctggaaacctgtcatcattggggactggcatgaagacactattattagtgtaaacttccactgaggagtccatccaggagacagaccgaattaaagggggaaaaggaatgtatgcccagtaggtataattttgagttgccccaacccctggtatactcaccactgcactgaccaccataaaggcagccagaattatattacccgtcacttttggaattcctttttcttgtagttatttctctgtttgatgggataagacctttatctggccccatgttggtagagtagaatgactggtgttggaggtcacacggtgagattttgttgtaatgtcgaggtcatggaatttatgtgtcaggtggcaaaacttgctctttgatttctgaggcttctttgccttttgtttctgagagttcttcatccttggagttaaaatgcaatctcagttgatgggagggaacccacacgggttgttgtccttctcctggggaaacacaagcgaaacccctaccccatgttaccacagtgcctaattcctatttgtcagtttttgtatccttccaccatacccactttcctttttgtggatcaaatctgtttccagtgaaatgttgttctgctgctgtaaaaggttgatttcttgctaggtttaagaaattgagtgtaaaaagaacaaaatttaactgagtatgggggtaggagcatccttcttctctttagtgtcctgttttcaaagttggtctttcagcattttattaactcgttctaccaatgcctgtccttgacagttatagggaatgccagttgtgtgagtaattccccatgtctgagtgaactttttaaaatcattgctaatgtaaccagaaaattgtcagtttttagtttctcaggacatcccataaccaagaaacatgaaaccatgtgctgtttaacatgagccgtactttcccccgtttgacatgtggcccagataaaatgagaaaaagtgtcaatagttacatgcataaaagagagtttgctgaaagctggataatgagtcacgtccatttgccagagaatattttgtgaaagtcctctagggttaactcctgaagaaagtggatgtaaaattaacacttggcaagtaggacagtgacatacaatggttttagcttgcttccatgtgaagcagaacttttttccgagtcccgcagcattgacttgagttacagcgtgaaaattttctacgtccataaaaatgggagcaactaatgtatcagcgctggcatttgctgctgagagaggtcggggaagggcatgtgagcccgaacgtgagtaatgtagaagggagaagaccttgctctgagtagggactgaaacttttggaaaagaaaaagtggttatcatcaggcagaaatgtgtttaaggcagtttcaatgttgcaagcaacacctgctgcgtacaccaaatcagaaactatgttaactggttcagggaaatattcaagaacagccatgacagcagtcagctcagcttgttgtgctgaagtagctcctgagttaaggacacattcttttggccctgcatatgctccttggtcattacaggaagcatcagtaaaaacagtgacagcttcagctaatggagtatccatagtaatgttaggtaagatccaagaagtaagtttaaggaactgaaatagttttacattaggataatgattgtcaattatacccaggaaacctgccaaatgtacttggcaagcaatgcaggttgcaaaagcctgttggacttgtaatcaggtgagggaaacaatgattttttggggctctgtacccaaaagatgaagaaggtgagaaagagcttgaccaattaggatagaaatttgatctagataaacggtaagcgtccgtaaagagctgtgtggaagaaagcactattcaattaaattatgtccctggataatgagtcctgttggtgaatgtttagtaggaaagattagtatttcaaaaggtaaatatggattcgccctggttacctgagactgttgaatgcgtttttctataagttgtaattcagaatctgcctcaggggtcaaagaccttttgttgcataaatcaggattgccccataatgttgcaaacagattagacatagcatatgtaagaatgcctaaggaggggcaaatccaattaatatctccaagcattttttggaaatcatttagcgtttttagagagtctcatctgagttgaaccttttggggcttaataaccttgtcttctagctgcattcctaaatattgataaggagaagaagtttggattttttctggagcgacagccaaaccagctgttgcaactgcttgtcgtactgcagagaaacaagatattaatacagaacgtgaaggcactgcacaaagaatatcatccatgtaatgaatgataaaaaattggggaaattgatctcttactggctttaatatgctccccacgtaatattgacaaatggtaggctattaagcattccctgaggtaggactttccaatggtaacgtgctgtgggagcgatgttgttaagggttggaactgtgaaagcaaatttttcaaagtcctgaggggccagaggaatgttgaagaagcagtctttaagatcaatgatgataagaggccaatacttgggaatcatagcggggaaaggcaagctgggttgtaatgtccccataggctgaaggacagcacttactgccctaagatcagtaagcattctccacttaccggatttcttttggataacaaagacaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccaaactcgggatcctgctgtggacgcctgggttccagggtcgggatcctgctgtggaggcctnggttccagagtcgggacccctttgtgaacacctgggttccaagctcgggatncnnnnnnnntnnnnnnnnnggggnnnnnnnntnnnnnnnnnnggntnnnnnnnncnanntnnnnnnnnnnnnnnncnnggnnnnnannnnggagtccatctctagccacggggccctgcagaaggctgctgtgcctcagtttccccatctgtaaaatggcagtagacctgctcgtggacctgtggtgagtccccctgtctggctgtcgtgtctgctcactggctgctgcttgtggttgcttgttaggtgtggttcctacaggcccttgcaggtctgtgtagactcagaggagtcgcggggcagaaaggagctttggggatggaagcaccagaccagtgaaaagagaagcagcggattcgacgtggccacacggggccaggaagtccccagagatcatgcctagctccgtcttccaggtcctgaaactttatctaaggacctcagcaagcacttggtagcataaagagagggtggtggggcatggggccctcctggctgagagtgcctttcggagaaggggcctgcccctngnantggnagcatttctcagatctgaaccctgacagatgggccaccaggggaccctggaagactgaactcctgtctcccactacacacacatgtacacacacacacgcatgagcacacatacacactgacattctcctcaccctgagtaacacaggatctgtgaacaccaattctagtcatttcagtgtgtgtacagctgtgtgagtgtgtgtacagctgtgtgtgtacagctgtgtgtgtgtacagctgtgtgtgtgtacacctgtgcctgtgtgggtgtgcacctgtatgtgcctgtgtgggtgtgccttttagggtgtgtacacctgtgtgggtgtgcatctggaatggtgtgtgaacgcacatgtggtctcaggtacacatatgcatgtgtgtgcacacatgtgtacagcctacacacacagaactgtgcacacactcaactgactagagttggtgttcagagatcctgtgttgcacatgtatatatgtaagtatctgtggatataggctgagcataaaagaatttaaaagtttgttctggtcnannggcancnngngtgtctcatgcctgtaatcccagctctttgggaggctgggatggtggatcacttcaggtcaggagtttgagaccagcctggccaacatggagaaaccctatctctgctaaaaatacaattagctgggtgtggtggcaggtgcctgtagtcccagctacttgggaggctgagggaggagaatcacttgaatccaggaggcagaggttgcggtgagccaagatctcaccactgcactccagcatggtgacagagccagactccatttcaaaaaaaaaataaaaataaaagctttttctggcatctctctctccccctttccacccatcctcctcttttctctcttttattcctttactgtaatgaaaaaaaggaaaggcagccaaggagaccagagaccagcaaagggccagcgagcttgaagtcacgtagacgtagattcaaaccccagctctgttattctctgtccagtgatactgagcaagtcacttaacccctccaagcctcggtttctcattcataccgtaggataaaaacatttgcctgacatagcacgcgacagtaagagtgcatgaattcancagtngggtggctaagtggctgactctggggtcagactgggtttgcagccacctgttctgtgagtttctaatagggtgaccgtggacagtttgttaccccctctgcctccgtgtcatcgtccctaagactgtcaccttgtggagttgctatgaggagtgaatgtggtggcatatttaataccttgcagcagtgcttggcacatgcaggagctttataaggggcagttattaaaatgtgtatcaaaggcacttaggaaaaaaaaagagagaaagcaaaaaagcatttagattgttttctcttcagagacanannnntncntntgctctgtcgcccaaagctggagttcagcggcgagatcctagctcactacatcctngngnaactcctgggctcaagcaatcctcccacctcagcctcccaagtagctgggactacaggtgcagccactgtgtccaggtaatttttgaaaaaaaattttttgtgtagagacaggatctcactatgttgcccgggctggtctgcaactcctggcctcttaaaatcctttcaccctgccttcccaaagtgctggngattacaggcacgagccaccatgcccagcctatttagagtttttaggagggatggaaatgatctaaacttggattgtgctggtggttgcacaagtctttaaatttgctggtggttgcacaagtctttaaatttactaaaaatcattaaattgtgcacttaaaatggttgaattttatggtgtataaattatgtctcaatacagctgttttttaaaaagcatttanagttagtgaaaaagcaacttgcagaataatatacacagtattgttgtcatttgtgaaacgttttaaactatgtaaaacaatacttctctaatatttgtcgtaaaaatatcaaatgcagcctggaatgacatatgtaaatctcatcattatgcttgcccnngnngggnnngnnnngagacacaagaagggaatttttatctgtaatgttttattgtatttatactttttaaaggccaggaaagctgggcaacgatgtcacataaagtcataacataaaaacggcaaagccaggcacaatggcgtgggcctgtggtcttagctactcgggaggctaaggcaggaggatcgtttgcatccaggagttcaagtccagcctgggcaatatagcaagtcgccatctctaaaaaaataaataatcatgggggcagggagaggtgcctaatgagagaaacacatgctgggggtggggaaggctggcaacttcctgtttcatgacttgggtggtgattatgctgatgtctgctttataactaatcattttaggcaactgtgttttatgcagttttatatgctatcgttcacaatcttatgagttcaaaaatctcgggctgggagcggtggctcgcacctgtaatcccagcaatttcagaggctaacgggggagcatcactctagcccagtagtttgagatcagcctgggcaacatggcgaaaacccgtctctgcaaaaaaatacaaaaaaattagccggttgtagtgggatgtgcctgtagtcccagctactgagggggctgaggtgggagaatcacttgagcccaggaggtggaggctgcagtgaaccgtgattgtgccacggcactccagcctgggcgacagagcaagaccccgactcttaaagaaaagcaaactaaacaaaaccctccataaaaaatgaaaaagttagggtggatatgttttgggatttgttatgttattttctacagtcttgtgtattaaaattcaaaataattaaaacaaaattatggcctgccttgcaggttggggtgggggctgttaggtatttgggataacacactgaagtgcctggngnganacngngnagggaggcttgcccgccctcctcaactaggggagccccgaggcgtggctgtctcctttccccggaggagcagcctgccctcccaggctcccagacgccagcagatgcttggcacaggggcctcagacagcctccctgatttacgaggctctacacgttccccgctgatggatggccctctgctcgccctccctcctccctctaaacgctgctgtctccaaggccactggcccagagtgggagccgcacaggcagggaggagccgggctggcctccctcctcctcccacccagctgccctgtcacccggtggtctcccccacggctgcctcccttccacctccgtgaattgagtgcttgccctgcatgagccaggcaccaggctaggcctctgcctccaaggaggcttgcagaccagaaatgagcagggcctgaacacagctgctttccacggttccccaggcctccctaggagttggcctcgagtgagaccttcagtgaggatgagcccccccatgggatggtttggtggcagaatattccaggaggaggccctggacagtggaaaggccccgaggtaggtggggctgtgagcctgcacaggtgtgaaagtggggagggtaggacaaaagcatgaaatgggctcttcctgagtactaagacctttctaccaaggccctgtgggaaggcgtgagccacagtcaccaccggggctgctggaagccaggtgcggtaggaacagtctccccgctggccacacaggggtggactttgagccctgagctagaaccccagagggagccgggagccctggccctgcctcccagttgctgtatgaccttggacagctcaggccgcctctcggcctccgtttccacattcgcagagctggtgaaagctctgccggaactcccgcctcagaatactgggccccaccctgggcctggagcctgggctccctgggaatgggtcctgcgaatctcccagggggtcccaaggcaatcgagttggaccccacagctcaagggccacaaagatggtgatgccccattcaggtcctcaagcaattcaaccccgttggggagacacacttggacaataatcacgaagcgtggtgaggcccacaagggtggccatgccaggggaccactgtggaaagcttgtcggaggaggcaacacctgagtggggtgttgagggcagcataggagtgtgccaggtggtcaagggtgaatgaggctgcccagcaggctgagccatccgagcaggggcgtggtggctggagctcaccagtgtgtttgggcgctgggctgtggtgggagtgggganngnnatggggggtactgnaatgagttacanaggacccttcatccctgagtctttgactcggaatgcagacagcaaagggctccccgcactgacccataagactggtggagcccacggcatcagtagcctccaggggagtgtgataggagggtgaccccatgccaaggccacaggacagatgcaataggagccaccgggcctccaccctctgccccgtagggccccttcacaccaagagctccagccaggctcaaccacaagcagctccccaaacaccacactcctccccatgcccggcctcagcacgtgctgttccccctgcctggaccccttcctccttcctgcagctctttgcctggctaaccttttctcagccttgaggtctcaggactgaggccaacgcagtgcctcctgctcttgccttagggcagaagaggggtcagggagacagcgggtggggctgcagaggtgggggctgccgtgtggttaacctgatgcagacccccagccctctgaggaaggctgggcatgagcctgaaggccaggccttgtagagagtccgggacccctgggtcattgtcctgtgggttcaagggaacggaggactggcccagccctggcaggtgccaccgaggatggtaagcaaagctcagctcagctcgccctccctcctcacccacaaagaactatgctctgccacctgcagccttaacatgttgggcaagcatgccccttcatgggggcaggggacaggtaactgtcgcgggggcgggggaacgggtgactgtcgcgggggcggngggaacgggtgactgtcgcggggcgggggaacgggcgactgtcgcgggggcgggggaacgggtgactgtcgcgggggcgggggaacgggagactgtcgcgggggcgggggaacgggtgactgtcacggggggggaacgggtgactgtcgtggggggggaacgggtgactgtcgcgggggcgggggaacgggtgactgtcgcgggggggggaacgggtgactgtcgcgggggcgggggaacgggtgactgtcgcgggggcgggggaacgggtgactnncncgggggggaacgggtgactgtcgtggggggggaacgggtgactgtcgcgggggcgggggaacgggtgactgtcgcgggggcgggggaacgggcgactgtcgcgggggcgggggaacgggcgactgtcacgggggcgggggaacgggcgactgtcgcggggccgggggaacgggcgactgtcgcgggggcgggggaacgggtgactgtcgcgggggcgggggaacgggtgactgtcgcggggcgggggaacgggtgactgtcgcggggggggaacgggtgactgtcgcgggggcgggggaacgggtgactntngcggggncgggggaacgggcgactgtcgcggggccgggggaacgggcgactgtcgcgnnnccgggggaacgggcgactgtcgcggggccgggggaacgggcgactgtcgcgggggcgggggaacgggcgactgtcgcgggggcgggggaacgggcgactgtcgcggggccgggggaacgggcgactgtcacgggggcgggggaacgggcgactgtcgcgggggggggaacgggcgactgtcncgggggcgggggaacnggcgactgtcgcngggncgggggaacnggcgactgtcgcnggggcgggggaacnggcnactgtcncnggggcgggggaannggtgantgtcnccggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccnncntncnnnnnnnnnttnncnnnnnnancntttnnnnnncntnnngnnnnnngnnnnnngncnannnnnnnncnncnnnnnntnncntnnggnnnnannngggnnnnggnnnnnnnnggnngggnnnnnnnngnnggggnnnncnnnnngntnancnnnnnnnnnnccccnnnccnnnnnngnangnnnggnnnnnnnccnnnangncnngncntnnnnnnnnnncnggnncccnnggnnnntnnncnnnnggntnnanggnanngnngnnnngnccnnnccnngnnngnnncnncnnngnnngnnannnaannnnnnnnnnnnnnnnccnnccnncnnnnccnnnaannannnnnnnnnnncnncnnnnnncntnannnnntnggnnannnnnncccntnnnnggggnnngggnnnngnnnannnnnnnnggggnnggggnannggnnnnnnnnnnnnggggnnggggnannggnnnnnnnnnnnggggnnggggnannggnnnnnnnnnnnngggnnggggnannggnnnnnnnnnnnnnngggggggnannggnnnnnnnnnnnnnggnnggggnannggnnnnnnnnnnngggggngggggaacgggtgactgtcgcggggccgnggggaacgggtgactgtcgcggggccgggggaacgggcgactgtcgcggggccgggggaacgggcgactgtcacgggggcgggggaacgggcgactgtcgcggggggggggaacgggcgactgtcgcgggggcgggggaacgggcgactgtcgcgggggcgggggaacgggcgactgtcgcgggggcgggggaacgggcgactgtcgcgggggcgggggaacgggcgactgtcgcgggggcgggggaacgggcgactgtcgcgggggcgggggaacgggtgactgtcgcgggggcgggggaacgggtgactgtcgcgggggcgggggaacgggcgactgtcgcgggggcgggggaacgggtgactgtcgcgggggcgggggaacgnggtgnacntgtngncnggggccaggggtaggtgacagtggtcaagggtgtcaattctggagccggtctgccaagcctcagggccagcctctgcttctttctagttatgagaccttggccatttgcttaacccttactgacgtaacacaccctattttactgtaataattatatgtttatttcaatgtgccatagagagacgtaatcagcacatcaattcccatcattgatattattgttaggacaaagctaacctgggtatttaagggatttttaagtaagtctgtttaaagaaanagtactaagtaaataatagtgcaggttccagttgggaagctgattcataagtgatgaangttaaggtaatgccagctggggttttccttagacccagtggtcttcgaactgttccccagaccctgggagccccagaaggttccaggcaggcagagatgcacagattaggggctgggagaggggtcagggttgctctccaggggagcatgaggaagctgctcatggaccaagtgctccccctcggtgcaatttaaatttgtttattgtgagcttatttttatctgctttttttagtgtggtaaaatagatataacctaagatataataccattccaaccatttttcttttctttccttttcctttttttttttttttttttgagatggggtcttgctctgtcacccaggctggtatacaatggtgcagtaatggctcactgcagtctcgatctccctagttcaagggatcctccccactcctcctgagtagctgggactatgggtgcatgctaccataccccactcctttttttttttattttttgtagtgatggggtctcactgtgatgcccaggctggtctcgaatccctggcctcaagcaatcctcccactttggcctcccaaagtgctgggattacaggtgtgagtcactgtacttggtcttttctttcttctttctttctttcctttctttctttccttctttctttctttctttctttctttccttctttctttctttctttctttctttctttctttctttctttctttctctcttttctttctttctttttcttctttcttctttttctctctttctttctctttctcttctttctctttctttctttatttcttttctttccttccttccttctttctttccttcttttttttttgagacagggtctcactgtgttgcccagactggagtgcagtgctgagaacatgattcactgcagccccaacctcctaggctcaagcaatcctcccgcctcagcctccccagcagctgggaccacaacctaggcgcaagcaatcctcccacctcagcctccccagcagctgggaccacagggtgtgcaccactgcacccagctaatttttaaaaaacattttgtagagacagagtctcaccatctttcccaggctggtctcaaactcctgggctcaagtgatcctcttgccttggcatccctgagggctgggattacaggtgtgaaccattgtgccaggccatttcaacattttttttttttgagatgaggtctncacnttctgttgcccaggctggagtacagtggcgtgatcttggctcactgcaacctccacctcccaggttcaagcaattctcctgcctcagcctcctgagtagctgggattataggcgaccaccaccacgcccagctaatttttgtatttttagtagagacggggtttcaccatgttggtcaggctggtcgtgaactcctgacctcaggtgatctgcccaccttggcttcccgaagcgctgggattccaggtgtgagccaccgtgcccagcccatttcaaccgcttttaagtgtacagttgagtggcattaagtacaatcacaatgttgtacaaccatcaccactatccatttcagaactctctcatcatctcaaacagaaaatgcatctatcaaataaaaaccccctattctctaccccaaaacctctggcaacctctattctactttcagtctctacgaatttgcctattctagggctaattttttccaacaggctaatacacatgcgtggtaagaattcacagagcaaaaaagtttccctgtcctctagtgctcttcccagatgaactgtggttaccagtttcctgttcattctttcagaggtattctgcgcatatacatacaaatatgcatgtgtatacatatcttttcatttatttacaaagggaatatgctttttatgcctcttgctttgtaacaataaatctgggagatgaaaagatatttagtacatcagaatatcaatatctcttccatatcagcacactcatctttgttaatgattgtgcagtattctattgtacaggtgaggcatactgtatttagccaatcccttattgatggaagctcttcaatttttaatctgttgcatttatctattgacagcacatgcccacccttagcagcagaaatgaagtagcactagttagcaaggagaactaattaaacataaaaaaaacctaccagactagcaaaaattcaagtctggcaataccaagtgttgacaaggacaaggaggaactggcactgttacagatggttggtgagaatggccgtggttctaaccagtttggggagcagctaggcactctctagtcaaggtaaagatatacagaccctaggcccagcaaatttcctatccaagaaactctcttaaagaaactctccctggccaggtgtggtggcacacgcctgtaatcccagcactttgcgaggctgaggtgggaggatcacttgagctcaggagtttcagactagcctgggcaacctggcaaaccctttctctacaaaaattataaaaattagccagatgtggtggtatgtgcctgcagtcccagctacntcgggaggctgaggtgggaggatcgcctgagcccagggaggttgaggctgtggtgagccgagatggtacgactgaactttagcctgggcaatagagtgagaccctgtctcaaaaaaagaaatcccatatacagaccaggaaacaggaatagccattgcagcatgttgatgatagccacgcataggaaccagcttaaatgatcaacaataggagaaaagagaaataaattatggcgtattcacatagtggaacagtagacagcaataaaaacaaactatagctagatgcatctacaggaaaaaacttcacaaataataataagccaaaaatgagtttaatgaggttatgtatagtatgatgccatttttacaaagttttaaagcttgcaaaacaataccatatattgtttataggtacacacatttgtagtaaatgtaaaactcagttcatgtaagcctgggcaacatagcaagacccatctttaaaaaataaaacataaaaagattaactggacgtggtggtgcatatctgtggttctggctattgaggaggctgagatgggaggatcacgtgagcccaggagttcaagactgcagtgagccatgatcactccatggcattccagcctgggtaacaaagcaaggtccagtctctaaaaaaaaaaaaaaaaaaaaaaggcggggggtgccaggtgtggtggttcacacctgtaatcccagcactttgggagactgaggcgggcagatcacctgaggtcaggaattcaagaccagcatggccaacatggtgaaaccccatctctactaaaaatacaaagaactacgcccgccaaacatggtggcagtcacctgtagtcccagctactcaggaggctgaggcaggaaaattgcttgaacccggganggtggaggtggcagtgaaccgagatcgtgccattgcacttcagcctgggcaacagagtgagactctctcaaacacaaaaagtggaacacgttatcattgaaagctaccacttgcattgttaattcctttgaattgcatcatgaattcaaagcgattggagggaacatttgtggctgttggccctgggtttccaccagccctgggctagttagagtttctactcattctaattcatgtataatgctgagatgttcacttcagtcatgaagaccctgggctctagtggtccccaggcctgtgggagggaggctgatctgtgctgtgatgtaagcctcaggctctgcccctctttctcccagaggtcatttctagagcttccccagaggattcagcattatccctctgtgacatctaatctcttgccttaggcaacctgatcctgggctaagtctctcctggcaggggagcctctcacccggcctctttccaatcccacagcacagaccttggcagtgtggagggagagagcctggttcttctgccgagccctgggcagccttctggtgtcccaggatagaagaaagactcacatttctttgcaccattgagcccatcactgcagcaccagagcatctgacatctgcaaaacaacatcnattaggtaggtgttaacttttccccactggtaggcctggtgctcgtaaatgtactgtgacgagtgtaatgtgtttatgagaatgcgcataaattatcagaaataggctgcatttttaatatcacttaatatatcaagttggcctctaagcagccacacgctatattgcaaatgttgagctgacttgctggcatcagtgctccatcatgctctccatgccgaggccatagcgtatgccaagaaggaggcaagggaccccntagagtggtggttcctacctcccttcctgacttcccctccatcatctggaatctaaagaaaaatgggcttcatttatcactgagccccctacagatcacagctcggggcctgttacagggcaggtgcacaataaatatttgttgaaatgtggcttcatgaataaatgaatggacaagagaccttggaatgcccctctccatcaaccagcaacattgtttggatttcctccatccaagcacctctgttgggttaaaattttctgttaatacagagaacgttctattagcacagcaggacaagatctcctccggttatcagggaagggtggaaacgggggacacatattaggcctgggtcagagagggcccttcttctccgggcacatggacaccagccaagatgccaaccaaggaacatccagccaagtgctgcacagagggcatttcctcaacaacacacgttacctactctaagaagagccattaactggtccttctctgccgagaccagcttggtcggggagaccctaacccagcggcgctagaggaattaaagacacacacacagaaatatagaggtgtggagtgggaaatcaggggtctcacagccttcagagctgagagcccggaacagagatttacccacgtatttactaacagcaagccagtcattggcattgtttctatagatgttaaatcaactaaaagtatcccttatgggaaacgaagggacgggctgaattaaaggaataggttgggctggttaactgcagcaggnagcatgttcttaaggcacagatcactcacggtattgtttgtggcttaagaacgcctttaaggggttttccgtcctgggcgggccgggtgttccttgccctcattccggtaaacccacaaccttccagcggagccgttagggccattatgaacatgtcacagtgctgcagaggttttgtttatggccagttttggggccagtttatggctagattttggggggcctgctcccaacacttctccaccgggaaagaggtcagaatacccaaacaggaggagatcagactccccactgtggctttgccaaacctctctggaaattccaacacctgccttgggttagtcactcacttccccagtgaagaatcattaaatattgagagatgtcactgatgggcatatgttacacatgtgaacagtatagaggcagcccagcaggttgaaaatcaccgttaaaccattagcaccctctaacccagcgagtctcaaccttcactgtgcaccagaatcatcaggggcgcttgttaagatgcatcctgagtgtgcacacacatattctgagtcagtgggtgtgagatgggggcctggaatctgcattattgatagacatcctgggctgggtgtggcaactcacgcttgtaatctcagcattttgagaggccagggcaggaaaatcatttaaagccaggagtttgagactagccagggtaacatggcaagaccccgtctctacaaaaattttaaaaattagctggggatggtggtgcatgcatttggtcccagatacttgagaggctgagttgggaagatcacttgagcctcgggaggtcgaggttgcagtgagccatgatcacaccactgcactccagcctcagtgacaaagtaaatagacatgctagtgctacagatacctggaccattttttaaagaacccactgtatctcacttgacaggaggagcctttgagagggtctgtggggagttgggagaaagctcagaagcttgttgggaaaagcagaaggcagagaggcaagggcacagggcttctgaggactgtgaccaagggcagactccatccacttaactttgccagaggctggtccagctgcccagctgcccacctcagcatggggaatggaaggcaacatgattgatgagcctttggacatatccaactgcttagagatgcccacacatgccagccagcgcccagccttggcaagtgcatccatttctcacctggtcctggcagcagacagggagcagccaaccacatgtcactggtagagaaatcaaggcaggcactgggagcgcaatgacagtttgcatcaggaaggtttgcaccaggacgattngcaccaggaagttttgcactgggacggtttgcaccaggaaggtttgcaccacgacgatttgcaccaggaaggtttgcaccacgacgatttgcaccaggaagttttgcaatgggacggtttgcaccaggaaggcaggggcaacagaatcacaattccctgagtgccagttgcacactgggcactgtgctaagcactgtatacccatcctcacctttaactcacacaaggttgttcttattctcccccattgcagatgagacccangggcctaagttaaacaacttgcccaaagtccggcacgcttaggaggaggcacacctgacttttgactctacgtctgcctactccctgacctatgctctttctagaaagtggacacttgcccagnataacaccacttctatccacttctatccctcggggaggccctaccccatttcagctgggctcagagctgggcaaattcagacctagagtggatttcaactctgccacctgccaaagggtagaccccaacatgccatgtgtttctccagtgggcatccttgggttcncctggctccatgcttaggaggctgggccctccacctgacttcttcaaagccctccccaagagccagctcctgcagagccaagagccgtgagccgatcctccaaaaaccagacccataggacaagaggccaggagggagcggccagctctcggtgaacacaggtacagggccttggcaggctcagcggtcaggacgtccaggtctcatctccagtctgcctcttgctagtcacttgacctcccgcagcctcagtttccccatctgtaagatgatgacgacaccctccagctccttagtaaaggaatgataaaatgacagttcagcgtctgtattttaatacctgcgtcattatgtaatcattttgtgatgcagccacctctggcacagaaaaagtcaccctgtgcctatttaaggattaatccccttaagcattcctggaaatgagaacccctctnngtgncncaggctgcccttccaggctcttctgtcctttccttggcctttggctcttggaaggctgaatatttctcccaccaggacctcagactatctttagggaaccccggctggttcattcccactgtaacccctgaggctcttggcctcctcctgtcctcctcttcctcctcctttttttccctccttcccctcctcctcagtttgggcttcccctgtccaagaagcctcaggatgagctttgggaacgaggttttacctgtgtttccaactctgctctgagcccctgagctctgtagtggaggggaggaaagggagaagggagggaaagtggaagcatcgaacagtcaggacactgggctctcatcgcagctctgccgccagccagcagtcaccctggacacatccttgtgcctgagcgctaatttcctcccctgtgaaatgggaacagcaggccctgcctacatcgtggggtggtttaaggaatcaatgagatgacagctgtgaatgttnctntggcgcagtacaacatatgccatgtgtttctccagtgttttcaaaggccggtagtgcccgccaccacccagttcagaactcaccacaaaacatgaatttctcatcacttctcaccacgagtcttgtctttccaaaggaagggagaagggaaagccagctgagcacctcttacctgtctgtgctggatggggccttgccacaaggctgtgcagttggaaatagcctcacttcatagatgaggaaaccgaggctcaaagaggtcaaatagcctgccagaactgtgcagctggaagccacaggccaaggctttgcctctctttcctctgctccccatcactctgcaggggttatggtgggggaacaagagaggcttggagcccctcattcagatgcaccaaaggcacccgctaagaagctaagtgtcttacacatcagtggaaaccagagggtaaacaggattccatccatgcccagggctttccgggaacacacctgtccaagcagcagcagttcccaacagagctctggtcccgganaagnccnggacagccagggnctgggccctctgggatttgtttagtgatctgaccgtgtgggaggcctagagtaggagtgggggtggggggagcgtgccgcccagccttattgcatcactcaccgcccaggccctgccctcacccgctcctgaccaggccctgtgcaggttctcagccaccctgccccggggggtccttcagactctactcactgaccaagtgagggactgacccgaggttagagtgctgtgttgtatgtgacctgagaatatgtgtgcacagactgagccccggtgtccttgtgcagttgagcgtgtacatgtcctgcccgtgtgtaggcaacctgtccctacatgctaggagtgtgactccacgtcctgctagagggggaggagagaaggagttgtgcccagggtcccctgatcacttctatgggctcatgtttgtgcatcttgttaggggtgcttgggggtagggaagcctgtgccctgggtgcccttgatcacctgtgtgtgtgctccattaggtgtgcgcgcctgtgcattgggggtgtactgtgtcacagcttcctaaaccaaccatgtgcgcatgcagacgtttgcgtgtgtgacctacggtgtgagcgagcggatgcttccaccacgtgtctctgcacacgcatgtgtgcacttgcacacctgcgtgtgtcccgagagagcgagcggagcccagcgtgggctggcacgcgcgggaacgtgtgggtgcgcgtcctgcgggtccctgccgggttgactcccagcttgtgccgcgggcgtgcatgagcggaaggcgcccggcggccctgcctggccgcgagtgtgcgcgcgcggggtcccgggccggcgtgcacgccggtgtgagtgcgagtgcgagtgagtgtggcnccgcgcggctccctccgctccgcgccgcccgcgcagcccgcacactcaccctgcttggttgctgccgggtgacgcgggctgggcccgccccctgcctgccggcctctggcactcgctcgcgccgtccgcagcggagcgggcagcggccaagtcagggccgtccgggggcgcggccggngatgcccgcagcccccgccgcgccccgccgggcctgctgagccgcccccgggccggggtcgcgccgggccgggccgcgcccggggcggggcggcgctgcctgcatgaccctccggcggcgcggggagaaggcgaccatcagcatccaggagcatatnnccatcgacntgtgccccggccccatccgtcccatcaagcagatctccgactacttcccccgcttcccgcggggcctgcccccggacgccgggccccgagccgctgcacccccggacgcccccgcgcgcccggctgtggccggtgccggccgccgcagcccctccgacggcgcccgcgaggacgacgaggatgtggaccagctcttcggagcctacggctccagcccgggccccagcccgggtcccagccccgcgcggccgccagccaagccgccggaggacgagccggacgccgacggctacgagtcggacgactgcagtaagtttcccacgcgccgacttcgcgccccctcccctggctcgggctcggcccccccacggcctcgcggcttccctccgccggtccccctcgcgcgctcgcgctctgcctcggttcacaaccccgccgcgggcttgcgggcccctggcgcactcggtgcgctctccgcgccctgcccaccggcctcgagccctcccccgacccaggccggacaggagggaagttcgggggcaccccctgggggtgtcccatttccggggccgggttcctcggagccggcgccgcgccccctccctgccagcccgccctcccggagctccggcgcgggcggctgcttttgttcccgggaagggcggagctgcgtcccggggagacaccagttgctgccggccgcgcggtcgctccccgctcgccagccgctccgggagggcctcgcggccgagggtcggggctggggcgagctggggaggggcccgaggctgggagcggcccggcctcccgcgtggtcccggcggcccgcagagcgcagctgctttgctggcgcgcgagcagaggaccaggaggaccgcggggccgcttgtcctttggaaaaaccttggcgtttcctcctccggtgtccatggaccccgccgcagccctcgccagggccgcgcaccttcgcccacctgttacgcccgcggcccccgggcagagagggccccccagcccgctccccctcctcccggactgagccctgagcccccgggagcaggcaagcgccggagtcccgnggaccgaggcnccnggccggtgggcgctcctggcgccttttcccgtccccgagggtgcctgtccggcccgagccgggactggctgggaaaccgaggccggaagaggtcgcagtccagtgaggagtcggtttgcgcggggtggggatggcatgtgagaaccccctcctagctcagctgtggctccagacttgtcactgagacctggaaaaccagcgtctcgtcaaaccccagcccttcccgggatgtggcccttctccagggctggtgctgcccctcccctgcgcagcagggatgtctgcgcctggcctgggcactcaccagggcctgtgggctgcgggcctggagtttcccaagcatcaaatgtgccaccagaagctgaaggtagggattaccagtgcccccggggcacagaccccccatcgccccacctggggaggcccatcagcagtggccggttagagcagggcccctgtaggggaaactgcctgctttgcactttctagaggcctggaccacggccctcgggccagcgcctggcacatgaaggccctgccctggggcgtgggggctggggagcagtcttgtccctccactttcctgccagcttggggagattgggtcggaagagttttttgccctcagggctgtgccctagatccaccccccctcccctctgcccctggcaccctgtgcgaagctcaccctggacttggtgatcccctgggtgggccctgagtgggacccaagtaactgctttggctgccctgaatccaaagcctcccccagaagaacggatgggaaagttgttcccatttctggcatctctgctgctgcaccaaggaagtaagaggggagggcagagcttcaggccaccctcctggtgccacagagggccctctgcatggcgaatggccaagaggctttttctttttctttttttttttttttttgctgtctctgaacccacaaagcaaggaggggaccaggaagctagaaactcaggccagccagccccatctccaatccatcagctcagcagcccttcagggagcatgtcctggcagcagggctgggcccctggcctgagatacatgcggtgcaggggccagactcacatgaggtcagcagtgcagggcagagctggatgcagctttgccagcttgaactgtgggctggccacacccgtattatcaggacatgccaaagaaatgctgaagacgggctcagaggagctaanggaggacggtgtgccactgagctagggccagcttgggcccctgtcgcccccttcgaggggggccccaccctaggcttggatcctatgggaggctgacaaacatcctaggcccagaagcccagaaatcttggctcttgtccatggtngggggaacaggttctggggtgggactgccttccacccagtaccccaggcggtgcccccctctgggctgtgacaaccagatccttagaataagcctcaatgattcaagccagatggttcattacggctttagccagggttatgctatttgctgccctaattattggattatctctgttctgacaaaaagaaatgagggcggttgctctgttgtccaaggcagagagtgaagtgctgtttatttactcagccttttctcctggctttttaaagccctttctttattaagtcatgtcaaagcacaagcacataactcgcatgttcccagcagatctcgaagaggggcgatgacagggaggaaaggcagtgaatgtcccaatgaggagcaggacccagtgtcggccctgccagttctcctagggtggcctctgtggcgtgctgccctccaggtgggccgtgggccacacaccccacacgctgcccctacctgagaggctctcctgcccggcacccacctgtggaagcccagtccattcttcaaagctgtaatcactagagtgccatgggttgcaagtgacagataaccaactcagagtggcttaaacaatgaggacagctgaggtcttgctgcaccagggtgcaccaatgcagcagcccctcagcactgttggggtgatggttctgtccatctttgctcgtggctgtgcgtttttccttgtagagcaaaatcaaggcccgtttcctattcctaagggtgtctgggtgaggaaggttcaggtgcagaccaaagtcagaatgacgctgtcagtctccatcagccaagcaggaccctcaggtccaaggtggctgctgcaggtccaggcatcacatgtaacaataaggtccttgactgggtaaggaattggtaaggaccgattccttttctcatgtctcagtttaagagcgaggaaacctctcccagaagtccccaggagacctgtccttttgtctcattggccagaattggatcacatgcccgtgttaaacctgccctgtgtggttcacccaggaccgggtcaggaccgatgcctgtgcaggtctggagcaaggacaaggggttgagtccaccacaaaggttctccgtgttagggggcatattccagcccccatgggctgtggtgccccttcctttgagcccagaacctctttggccccagtcatgttctacctggacctgtgatatttgtaatgcactcgatgttacggcaccaactatgtggcaggctctgtgttaggcacagagatacaagaatgctgagaggcaacctctgacctgagggtgttcatcaaaaccaagacaaacaggtgaccctacagcgagggacagggaggcaagaacccagatggaaagctctggcaggcggaggtcactcacagagagggctcagccctaagactgggaggagggaggaggtgggctgacagagggaaaagaggaaagggaggtgctcttggcagagggacagctgtgtacacaggtcctgaagtgtcagaaactcagcccagtgtaggcaaaacagtagagccaagtggctcaaagaaggggaagagacctatgaggaggccaaagcggtcatatcacacaaggtcttgaatgccacaccaaggaggttgaactgagtccaggagttgatggagaacctttcaacaatttaaagcagatgaatgaagatgtttataaaaatcttaacactcgtctctaagctcctgggaagcagggatgatggctcatttctctctgtcccccctgcagtgccggcctggctgaatggctgtttccccaactataaaatgctttcaacacaagcttgatgattttctatggtccttgccacaattgttttgttttttttttaaagtatttgagagcnctgacatttttcttnaaaaaaaaaaaaaaaaaaatcagnggcagatttcctattcccaagggtgtcaggaaagtccaggtgcaaaccaaggttatgatgatgctgtcaggtctacatcagccaagcagggggtgctcggccttagaggagccaacaggggcttgagcttgattttctctgaattagccccattaaagctctgtaattatcgacaagcgggtgacaactctcaaaggcccattagtgaccaaccctcattatttttccgaagatgtaaacttcagtggggtcatgtgattggagcgctccaagggcagggcactgtgggtcacagagaagcaccttctcctgcccttagggccctcctcacgcccagcacaagcccaaggtgcttttccaactcggagggctctccagggcagcggctgagcccccactctccttcccctagagcaactctgcttttctctctttttgtttcttagttgcatcctcctaagatttcagctaaacaaagtggccaaaaaaaagctttttggaccagggcagagtggcccgtgtgtgcctgtaatcccagcactttgggaggtgaaggcgggaggattgcttgancccgggagttcaagaccagcctgagcaacgtagtgagacctacccccccgcaccccccgcaccaacaccactgtctctttttttgtaaatatattttttaagttagccgggcatggtggtgggcgcctgtagtcccagctacttgggaggctgaggtgagaggatcgtttgagcctgggaggctgaactgtgatcgcaccactgtactccagcctgggtaacagaacaagaccctgtctcaaaaaaaaaaaacttcttgggagccagtaggctttaagggagaaactatcaggatggaagtgaagaggcctagattctgtgcctgggtctgctgggccacgctgagcagctcccctcccctctctgagcctcatttctctaaagggaaatgaagagtttgggccatgtgctccgtaagagagcttcaccagcctctgaaaactgtgaccgagcttctatttataaactatcatttcttacagaccttccagtggagttcaaagaaattcatcagtcccttcctggtgacacactgggtgtgctgttccttcccaggaggtggtgacgggtgtcagttttccccccaggcagttggagaagatcgctgccctccttggacaggggtttctgtagagccagtgcaggggcttctcccctccaggagctgggtgtcccagggggagcaggcagccgctctgtcttctggctgtccttctctggggttgggaaacaggcagaaatcagaatgtgcatttttacacttgggtgtcacaccagatcccagctcctgggagcacctggagggcaagttggtttgaatggaccagccatgtgtgtctgcatctgctgtttgttggtctcacaggtgtggccaaggcatggtccctgtgctcagggggctaattcgttgggggaacaaaccccaggtaggcctgacctgaacagcagatccatttactatcatgtaaagccaacagcttcagagaatattgttacaaaagtacagattggtgcatctcgggctgtggctgtgttcattgctgcaggagcagtgggatacacctcccttccagcagcctcacctgcctggtgtggagatggcagctagcatgcaggcagctgaaggccagctacagctattgctgctgcacacataccctgctcaggagaacgtgcctcaggcttcactcaagacctagtatttatttatttttttgagacaggatctcgctctgtcgcctaggttggatgcagtggcacaatcacactcactgtagcctcaacttcctgggctcaagcggtcctcccacctcagcctcccgagtagctgggaccacaggcatgcgccaccatgcccggctatttttgtattttttgtagaaatgggtgtttccatgttggccaggccggtcttgaaatcctgggctcaagtgatccacccgtctcagcctcccaaanngtngncntnnggattataggcgtgagccaccacacccggccatttttgtagtttttgttgccatgttggccaggctggtctcgaactcctgagctcaagtgatccatctgcttcggcctcccaaactgctgggatgacaggcatgagccccacaccagccactcaaggcctgttggctcttagtttgcacacacttccaacaagtatcatcacctggtctcatgggagaaacaattattgaataggtgagagctgtctgcgccaacacagacaagtaatctaataggagtttcaggctgatgtcaaaggaagaggcagaaaaatgaagaaaaccgaaaagagggccacccgggaccctctggtgcaggggttgcttcgtgtccccttttgcctctggaacatgaccgtgacatacggaagagtcatcgtggccatagcaatgactcaggttattcaaaaaatttaagtgactatttgtatgttctgttcccaaaggcagggagggaaatgagccaattgaggacagtttcattccagaatgggtcttagagaagccagtactgttagctagaaaacccaccataggtatctgctccttctataatgatctactgagcacctcctacaccgcaggcacactgtgctgtgaggtggatactatcgttgtctccatttcacagatgagtaaactgaggcataaagacgttagataagctggccacacagcagggaagtgcacgctgggatttgaaccgaggagactgatgtcagagggcaggtcttgcaccccacactgctgcgaagacagagacatgtgcctgacccgtgttagaaggggatgatctagacaaatgccactcccatcaccagctcagaataaaggacactccacactcgtggcctttcattagccaatttccctgcagacccaagaaactttgttatgcctgggcccagcactcgcccagagatctgcaaacttgttctataaagaagggctggatagtaaatattttcagctgtgcaggccgtagggtctgcttctgaagtaggaaagcagccgcagaagagatgtaaatgatgggcctggtcaggtgtggccgtaattggatctagatccaggttgggagcctagctcagagcctgaagaacacagtctttcaagtttggccttcccttatcccgggatcacaccagccactaagcccgtacctgctngngttggcctgtggttggaatcgtcacctcccccagcccctctttgccattggccaactcctactcatccctcatggctcaggtgaagcatcacctcctccaggaagccnttccctggtggtcccaattcacatgggctccccatggctcccggctcaccagactctactgcggcaaattatttccatttgttcctccccttaagctgtgctttccttgggatagggactctgcctcacagatgtccatcccctagagtctggcatgttgtaaacacttggtaaataatgaaggaatgtgacaccatttgaccagccctgcagcctgggagcaggctctgggcttctgaagccatctgtgaatgtgcatcttgctgtctgcggactgccactaagctctgccccccaccatcatctccaagctctgccccaaccatcaccttggcctccatgctgggagccgcttctgcatggaaagccacagctgctatgagtgattgcccccggggagggaggcagctgcacccaattatggctgcaacctcccccnaanttatggctgcaccctccccccggcttttgggagttaccactgccattgagagacttgggggcagcagtatgaggacccagctggctcctcacggcctgctcggggttcccaacgggccagagagacagaggagctgcagtcctgtgtgttggctgggggactgttgagcaaatcagctgatcttcctggccaggacctgttcctctcaaagcctcgtctcctccgccttgtgtgatccttgtgacatttcacaggtgagggaaactgaggcacggggcccagactggcagttgcaccaggagggcaggaactcctttggctgggtgcccagctcaggtggaccacacactgggccagacagggaactggagtgacccacctgacctctctgggtctcagctcctcctctggaaagtggggagattattgtgacttcccagggttgggtgggactgggaggatgggtgaggggctggcatagagcaggtgcnttnggttggtggcagccgccatggaacggtggcacctgcccaggccaggctcatctggtctcacaggggcaggcgaagcctctccaagatgcggccagggtgggacctgtgccctcctctgtccgcagctgccctgggcacgctggacttcagcctgctgtatgaccaggagaacaacgccctnccactgcaccatcaccaaggccaaggtaggccccgccagcctgcacccaaattccctgccccggggtcctcaagagggcctaggtcagggaggccagaccacaccactccccaggttcctgtccaggcttttggatgtctgcgctgtgtggggtgcgggaccaggaaggaattcttctttaaaccttcttgaatacccaaccccaagaaatgccttggacagtcaggcattgcggggagcaaagaaacagatgagaatgggaagatgaaggcctggaccgaggaccctcgagcctggggaggggctgctgagagggaaagagaggggcagggtgatgtctgtcctgcaggccaagggagggcgggttgggtactggtgcctccaggcctcccagacgccctgaggagtggggacgccactttgcaccctggaagccgagccactgtaggaggccgatgccactccaggcagggtgtccacggcctgagcccagaggccctctgagcctcactacgtgggctggggttgtgggtgcctgtggacccctctgcagcctggcccggccgctggtgctcccctctgcagcctggcccggcccctggtgctcccctctgcagcctggcccggcccctggngctcccctctgcagcctggcccggcccctggtgctcccctctgcagcctggcccggtccctggtgttgccctctgcagcctggcctggtccctggtgctcccctctgcagcctggcccggcccctggtgctctcccctctgcagcctggcctggtccctggtgctcccctctgcagcctggcccggcccctggtgctgccctctgcagcctggcccggcccctggtgctctcccctctgcagcctggcccggtccctggtgctctcccctctgcagcctggcccggtccctggtgctcccctctgcagcctggcccggcccctggtgctctcccctctgcagcctggcccggcccctggtgctgccctctgcagcctggcccggcccctggtgctctcccctctgcagcctggcccggcccctggtgctcccctctgcagcctggcccggtccctggtgctcccctctgcagcctggcccggcccctggtgctcccctctgcagcctggcccggcccctgttgctcccctctgcagcctggcccgatccctggtgctcccctctgcagcctggcccggcccctgttgctcccctctgcagcctggcccggcccctggtgctcccctctgcagcctggcccggcccctggtgctcccctctgcagcctggcccggcccctggtgctgccctctgcagcctggcccggcccctggtgctcccctctgcagcctggcccggcccctggtgctcccctctgcagcctggcccggcccctggtgctcccctctgcagcctggcctggtccctggtgctgccctctggctctgccactcaagcatgtgtcagctccatgttctcaactgtcctgttcccttcccctcaccccattgctccctgtgggaggaaggtgccaaaattgatgttctctcgcaaggtaagggcctgcatggccagtagagtctccctagtagtgccatgtaagggcctgagccagcccagctcagatccagcggcttcccacagagctgcctgggcccaggccccacccagcctcccaacctgcaggccccctgcccctcctcccagcctggcagcaagggctgcccttggcagcatgctcacccagcaggacaggctactgcgtgccaccccaggctgtcccccagcccagcctgggccacatgtggactgccgtgggtaggtgtgagtgccatccacgcaagcctcagggccctggtagggcactgagaggcctgcacgctccatcccacccctgccctctctagaaccacccatgctatgactcagggcatgtccagccctgcctggcgggggctccagcccacccctaggagcagaactgagcatttgtcaaaccccagctgtgccaaggtagagaccaagctagacccttcctcctttccctctgtccaactttgtagaggtggtccaggcctggggactggagaggtgccggctgccaggccactctggccaaagcccaccccttncctctctccatgccagacaccagggccttcccttcccagctccaggtgcgtttgtgtgtatgcacatacatggctgtatgtgtgtctctgtgtgtacatgtgtggtaccgtgcgtgcacacatgtaagtgtgtgtccactttgggctgtatccctcaggtatcagaagtgggggtgggaggcccagttccttctctgtgtaaatccagttctgtagggaaggggtggtgcaggctggggaagagctggggctctgggctggggtgtggggaggggcccagggtgggtgagctgaagcagggctggcctctggagggccagggtgggggctggacaccctnggggtgcacccttgcttgtccccccttataagggtcagtctcagtttgcccatctgtaaatagggttggttgtccctgccctacatgcctgttgtgagcattaaatgagttaacacgcggcccctggcactaccagttctgggagactttttatttttattgtggtaaaatacacagatatacatttcccacctcaaccacttttttttacttcttccctcagcgctcaaccatttttagcgtacagttcagttgtgctaagtaccttctaccttcacactgctgtgaaacccatctccagagccctcttcagcttgcaaaactaaactggacccattaaacaacagctcccccttcctccntncnccctnggcccctggggaggctgccatttggcttccttctctatggatttgactattctagggacctcatgtaagtgcagtctcccggtatctgtccttttgagtctgcagtccccgggatctgtccttttgagtctgccttctttcactccgcagaatgtcttcaggcttcatccccattgcagcacgtgtcaaaacttccttttcaggctgaatgatacttcagactaggaagctcctcttctgaacacttcaccagcaacagcctctgagaggcccagggcggggcagggctaggtttttggggagaggctctcctctcaaagccagaccccccatctcttccctcagtgccagtaccagccagggcctcccccggggccgcttccacccatcctccctgtattagtccattttcatgctgccgataaagacatacctgagactgtgtaatttataaaggaaagaggtttattggacttgccgttacacgtggctgagaagacctcacagttatggctgaaagtgaaaggcacttctcacatgtttggtggcaagagagagaatgagagccaaggaaaacgggtttccccttatcaggccatcagatctcgtgagatgtattcactaccccaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcctgagacgtattcactacctcaagaacagtgtcagaccatgagatctcgtgagacgtattcactacctcaagaacagtgtcagaccatcagatctcgtgagacgtattcactacctcaagaacagtgtcagaccatgagatctcgtgagacgtattcactacctcaagaacagtgtcagaccatcagatcntcgtgagacgtattnactacctcannaacagtgtcagaccatgagatctcgtgagacgtattcactacctcaagaacagtgtcagaccatgagatctcgtgagacgtattcactacctcaagaagagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacctcaagaacagtgtcagaccatgagatctcgtgagacgtattcactacgtcaagaagagtgtcagaccatgagatctcgtgagacgtattcactacctcaagaacagtgtcagatcatcagatctcgtgagacgtattcactacgtcaagaacagtctgggagaaacctccccttgtgattcagttatctcccgctgggtccttcccacaacctgtaggaattatgggagtacaactccagatgagacttgggtggggacaccgccaaaccacgtcacctcccgtgaggcccacccctaaaccatgggatcagtttatgtctcttgccaactcccaagctggggagcatgtgcccaagggccccactagcagctccctgccctggaaacagcctcccgaccttccccttccgtggacagaggtcaggctccgtgggaggccagccccacagaaggtggaggcactggcggaaccccgggtcaggaccagggaagctgcctgtttgggcacagaagttggtggcagcacagtgacagggcttcaggcagtgcctgctggtccttttgcttttggcgaaatgtgtggctgcccagggtgctcagggaactgccgggtggaggagtagagagcagcagcaggggcctcgtcacagtcccggggtctgaaggacagagcaggcgtcactcccgtcccagcatgacagcgcccctcgacccagcctagctcccacgggtgtctcggggtacggaggtgggaccaccagagccactggaaagacatacgccagaacatgtggtggcccaaaggtttgtaagtgaaacgtgtcaggaaacgtggcccaaatggaaacattttaagctacaacaaacaaatgtataaggactgtaagaataagacacagcagtcaggcacctcctggtcaggccaggccaccagattcccagaactctgcacttcaggcacttggtgggaaaggtgcaaggcagggtgaggngagttgggtttggaagagcagccttgtcaccttgagcacgtgttgggccactgagccaggccctgtcccagaggcagccccacagtgcagggcacagctcagatgcacccagcagacctcaaccgcttctccggcgtctcacgggggcctggcgtgcagggaagggagcaaaccctgcctgccaggccctgtngtccncacagtctccctccctctcactccagccctaggaaggtgggagtattacacccccgccctttttttttttttttttttaaacttgagacagggtctcactctgtcacccaggctggagtgcagtggtgcgatcacggttcactgcagcctccgtgtcccaggttcaagcgatcctcccacctcagcttctctagttgctggaaccacaggcacatgccaccccacccagctaattttttagttttttgaagagacagggtcttactgtgttgcccaggctggtcttgaactcctgggctcaagcgctgggattacaggcgtgagccaccgtgcccggccaacccctttaacagatgataaagctgaggcttagcgtgcaaagtaactcatccacttcccagctggtgaacaggagctgagcctggagcccaagccagccaggcccccaaacctctgccctttgccagtggcagggaagtaggtggttggaagcccctgccgcatcccccagagctccgtcaaaccgaggtggggtgggcctgggagggnagccccagcctccccttggagatgggcctggtgtgagccgccgagctgcctccctgacccggctgggtagaagccctttgaatactatcctggggttgccggctgcacccccacnanngatgccacagctgcctccctgcatccctgtgcaccatcccagaaggaaacaaatgcaattttcagagacaagagcctgctgaggtcagcaaagcccctctctgtccatgcttctgtgtgcctctggctgtgcacgcgtggctgggttttctgaaagaaccagagtgagagaggggtgccatcttgtggagggaccctctgtggccagtctgcttgtgtgatctctgtggactgactgggagttgtggcaaatatggccagaaatggggcctagtctcggactgtgtcccggggttatgtggatttagggtcagtgaggggcatggccactcaggaggccacgcttggtagatgggagacgggagtcaggatgatggcagggcctgagcaaagcagggtggagagggaggctcagagaagggggagccacctggcttccaggatgaggacaagagaaagtctgtcctgacagaggccccatgacagctgccctgggccaggatgttttggggaggggagattgcatcagcgttgagccatcctcancntnccctnccantctnggaggtgtggggcccgggggcttctgtgaaaggggccatgaatgggcccagccaggagacccaggggacaagggcatctgcaggccctgtcagttccatgtccccgatttccagttcacaccgtttgctgttctctgcccagggcctgaagccaatggaccacaatgggctggcagacccctacgtcaagctgcacctgctgccaggagccagtaaggtgaggggttccacccaggcctgcccaccagctgcacccgcccaccacctcaggcaatgcactctggtccttttgctttggggcctggactgggctgcgggcacccagggaggcccacagctgccactcccctcagagtccaagcaagctgatgggacctcagccattcaactgcacacagagcacccagtctgccccacaccctgttgcctcctggggacctcacgagtcagcgttacctacctgctgatctggggaaacccctggagaatttccaggccagcattttataagaagcattctcagctggaagttactattaggtgcaaacaaaggactctgtggttaaataacatnggnnggaaacattgttaaacaggtttctgtaccacaggacttctcagagcatctaacgtgttgatgggctgttccctgactctccgcaangggggatgaagtgggcagaatctgcccctcattcctacgccggatgacccaagcgtccgaccacacatgtgctcagggcaccagcacaacaggtgcatctcggacaggagagagaaaaattgctgttaaataaaagcatcaaggtgaccttgagccatggaaagtcagaacttaattagacttccttctgtgcatcctactcttcagtgctgttttatttttaatttcatggggcagagtctgagtttacgtggaggcctaaatgggtaggcctggggcccacagcagcccaggaggaccaccccagaaggggcccttcccccttctctagggaaggcaggactgtaggagaaatggcagtgccccaccacctactcctggggaagaaatgggctccccacaccgggtcttgatgcccttatgctgcaagaagggctcagggatatgagggccgagggcgagtatgaccagggaagtgtgctcagtgacccttcatttgtgggactggagccggcagtgcatggctgccgagttgtaggaagtccccaggactttccctagtgttttataaagagcagtctccttacaaacagctcctgaaagcaatgggagagagggattcctgtgccctttccacagtggggaacctgatgctgccacagagctggaattggaagcccaggctgtctgacctcccagcctgggccgggtgtggcaggcatcagaccgattcagacaaggagctcagagccgctggcacaggaggagggagtggcagcaatattccagctcggagaggccacccccgaggcagacccaaggacgggatgggttccaggcagaggggacggtccacaaaggcagggaatgccctgggaaggagactccagttccacacaggcctcctgcagaacctaccccgtggcatcgggctnggaggtggggtcctccttggatgagcctcctacggctgctgcaacaaatgaccacaaacttcgtggcttaaagcagcgcgtttactctcggactgctctgcaggttagaagtccagcagtggtctctctctgggctaaaatcaaggtgtcggcaaggctgcattccttctggagcccggggagcccacagtttcctagctccttccagcttctagaggccatcggccctcctgggcttgtggccccttcctccaccttcacagcgggccccattgcatctctctggcccccttccttggtgacgtccctgactgtcttctctgtccattcttctgcttttaagaaccctgtgaccacattgggccacccaacaatctaggataatctccctattctaatgtcagctcattaccaaccctaagtccacctgcagcctcagtccacttggccatgttgataacacattcacaggctccaagatgagcacgtggccatctctgggggccattgttctgtttgatacacactttgatgctaataagatcatttttctcttctccaggcaaataagctcagaacaaaaactctccgtaacactctgaaccccacatggaacgagaccctcacttactacgggatcacagatgaagacatgatccgcaagaccnnctngngngtnngggtgagggtcccaggccgcctgctncccntcccncnaancnccccactcccacccggcttttcctaatgaaggcaggactggagggtcagatggtcccctgtgggttcaacctcatgccagcaactccagcctgggggcttgaagaaaggcagaaaggtctgcccacgccaatggagcctggtgggtggaaaagggtcaccctggccccagtcccctgaaggtgcttcctggggcctctcagggtgctggaggtggttccctccagagaaccggctctcccagcctcctggctactcctggcactggttctgccttctcctgtcccctcttccaacctgaggacacttgtccatgaggacagtgcctgatatcgtgccacactctgcccctgtcagggcccaggcatcttgtgcgtctcccaccccagaccagggcagggcttggggcaggagaagccagggctggccctacctgcgcacacctccaccatgcccagtgcgtctgaggcactggctgtgcccctcaccaccgccccctctaggatctctgtgtgtgacgaggacaaattccggcacaatgagttcatcggggagacacgtgtgcccctgaagaagctgaaacccaaccacaccaagaccttcagcatctgcctggagaagcagctgccggtgagaggattgattgagcacctgctgtgtacctggctcggtggcaggtgctgggaaggcagaacttcctgcctgtgatgggactcatgaggggcagagtgagaggggaggggagaccggggaggtgagcatggagagtcaaggggngtgngnagngtgaggaaggaccctggctttcactctgagtggccacgggagggtgctaagctgagggatcatgggggatgacattttaccaggctcgctggcctgggctcaggatggcttgaagaagagggaggagagggcaggaggcctggggagatnggggagagatgggcacaaccctggcctgaccttggcagcggtaggagggcttgattctgaaccggatgtgcaggcagcagataggacgtccttgggtgagggaagggcagatccgaggtttggggcctgagccactgaagcctgaggggctgtttgctgcactcagaggactcagcagggaccacgggtggacaggacgcgcaaggagcacgcttggaacatgttagacctgagtgcctgtgagatacgcagaggagacagcagagtatcctttcctagaaatggcatttgtctcaacgttatgtcagaacagatttgccctcggcctgctccagcagctacgccctctgagtcttggtctctatgtccctcttccctcccccatcctcccttgtctatggcctcaccttcacctggttcatagggctggtgaagccaggagtcccccgtgccactggggtcaagagaaatcctggggcctcagcctcccagcgttcaggacacaggcggaggcatggtcccctcgatggcacgttgtccccctaagaggactgggcaaggggcaagtttgggaggacagagcccggcggctgtccccagtgtacccagccccagtggggcccggggacgtggactcacctcgagcttagcccaagtcaagccccgggggcgagtcagcctgaggccacggcttcttcccagaatcccagttacttttgcagaatttgatccaattttattccttgtcacattctctccccctcagacatttgtgtgatggatataacctttcctgttttattgttagtcactaaccacaggtaacctggtttttccacatggtctatgtcacttaagaaagncaacntcttaggaggccaanggcanggtgggtcatgaggtcaagagttcgagagagcctggccaacatggcgaaaccccgtctctgctaaaaataaaaaaattagccgggtgtgggggtgcatgcctgtaatcccagctactcaggaggctgaggcaggagaatcgcttgaacctgagaggcggaggttgcagtgagccgagattgcaccgttgcactccagcctgggtgacaagagcaagagcaagactctgtctcaaaaaaaaaaaaaaaagcaacaccagccctgccttagtgttcctgagttttcatcactggcataaacaaacaaccacgtgggtatgtacgtggggtgtcagcgtgtgtgtgtgtgtgctcgtgtgtgaattgtgtgtaagagcatatgtcagtacgtgtctgtgtgcgacagtgtgtgtgtccacatgtgtggtgtgcgttcgtgaaagcatgtgcgtccctgtgcgtggccatgatcagggcgttgctggatgcgctaccggcccattggtgccgttcagggactcacagtgaccgcaggagtgcagctggggatgcacccctgacagtacagccacattctggtggtacttttattattattattttttgagactgagtcttgctctgtcatccaggctggagttcagtggcaaaatctctgttcactgcaacctctacctcctgagttcaaacaattctcatgcctcagcctcctgagtagctgggactacaggcgtgtgccgccacgcctggttaatttttgtatatttggtagagatggggtttcaccatattgtccaggtgtctcaaactcctgaccttgaatgatccacctgcctcagccntcccaaagtgctgggattacaggtgtgcgccaccacgcctggctaattttggtatttttagtagagacgggggttcgccatgttggccaggcaagtctcaaactcctgacctccagtgatcctcctgccntcggcctcccaaagntgntngggattacaggcatgagcccctgtgccnaggnncctctggcggntaggnttttnagaatttacagtctgcgaacattatctgttttaagtcaatactgagcaagacccagtggtcttcatatgaaacaacccgaagtacaatgtcccacccctgaaaaaagagctaaaaatatgcctgctggttggttgtttttttttttttttttatgnnagnatggagtctatngnnntncncccaggnctggnagtgcagtggcgcaatgtcggcttacttcaacctccgcctcccgggttcaagtgattcttctgcctcagcctcccaatagctgggattacaggcatgcgccaccacacccggctaatttttgtatttttagtagagatggggtttcaccatgttggccaggctggtcctgagctgctgacctcaggtgatctgcccgccttggcctcccanaangtgctggggttacaggcatgagtcactgtgcctggcccctgctggtttatattgtttaattttcacaccacacacactgacacaagcagcacagggcatcaaggccctcacacacaaagctctgcctgagcggcagatagcgagatctcgcaggcctggcctgatccaccaggaatggctgcctgagcactgtgttgaaaaggattctgaggtggcattggagcctagggcaaatgctaggatcgattagccatgtctgctctgggcgtgggaggtggcgaaggtggctggtggggcatgtatgtcttccctgctcaacatccctgctcacctcacaggagtctcatctccagaaagggttagatgtagccagagggactcactttggtgttaggcagggcacggttgtgggcaaaaggaggtggctggggctgcttgggagaggagcctggtagagtcctaaggggatccagggggacacagggctcaagctgggcgtgtgtgggtgggctcaagctgggtttgtctgggggggctgagggcctaggagagagggtttggggtgtgcagcagccagaaggaagaagccgggtagtctcgggagggcaaggaatggagaagcatcaggctggctggggatggggaggcctggagctgagatctgccttgagaggcaggcactggcagctgctgaggcagggaaggcactggatgggctccctacttggctcccagcttctccagggtgaggaatgtaccagaactctgtcttcggggttctcctgagggagccacatccagcaccctgagaggctccaggtagcaccttcagggaactggggccacggtgacccttttccatccaccaggctccattgtcatgggcagacctttctgcctttctttgaacctccaggctggagttgcttgtatgaggttgaacgcacaggggaccatctgtccctccattcctgccttcactagtacaagcctccagtgggcccttagtgccagggccttgcccagccctgaggtattaaagatgacgcaggtattatctggatgcggtggctcatacctgtaatcccagcacttcaggaggctgaggtgggtggatcacttgaggtcaggaattcgagaccagcctggcagacatggcaaaaccctgtctctaccaaaaaatagaaaaattagactgtagtcccagctactcagaaggctgaggcaggagaatcgcttaaacccgggaggcagaggttgtagtgagccaagatcatgnccnnnntgncantncncnangcncnnngggnngnnnnnnnnnagntnagactctgtcaaaatcaaaatttacaggtagagttccaacttcaaggaacttagaggctggggcagagccctgaggaagcagggggccacaccaggccatgacaggataaacccgaggcagtgggcgcgcagaggggacggccaacccaccctgagggtcagaaaagccccccaggcccagaaggaccaggaatttatcaacggtgaacactgaggaggtcagaggagggtgctggagctgtggattaagggtgcgcaaaggtgtggaggtgggacccggcttcaaagccaagggaaagtccgggcgggctgtgaggaggacctggtggaagaccgtccgcggaagccgagcgcgccaggccgggggctgcagacccgtgaagggccgcttagcgctaatgttaggctctgtgtgcctcgcaatctgtggccaccatgcagctctgtccttagggcaaaagcagccatagagaagcatcacggagctggcaaggctgcgttccaacaacacggtgttaatggaagctgaagtgtgaatttcatgtcattttcatgtgtcacaaaatatttttcatttcatttttctttctgctattccaaaaagtaagaaccagctgggcacggtggctcatgtctgtaatcccagcactttgggaggccaaggtgggaagatcccttgagcccaggagtttgagatcagcctgggcaaaatagtgagacccctgtctctatttttttgaaaaagaaattgtttaagataagggtaagagccatgcttagctcacatcccacacagagccaggcgtcgggcctgatctggcccccgggctgcagttgccaacccctgggctggcccttgctgggctgtgaaggccaccgtaggccacatgcagccaagaacagggagggtgtgggtcagatccagccctggaagagcccttgggagggaagagatgacagaagggctgtgagttcacagtgaggccactcaccagggaccgtgaccaggcccggctgcagcagccggatgggcgggctcaggaagaggaggccaaggacggccaagagaggggtgggagcaggtgaggactgagtgaccgtcccgtccaacaggtggacaagactgaagacaagtccctggaggagcggggccgcatcctcatctccctcaagtacagctcacagaagcaaggcctgctggtaggcatcgtgcggtgcgcccacctggccgccatggacgccaacggctactcggacccctacgtgaaaacgtgagtgtgccgtgcgcgtgaccacctgccacgtcttcacctccaaggacgggggtccgtgtgccggctccgtggtcccaggtggcaggcacccagggagtgcctgaggtacaggggcgctgtgttccctgatgggctaccttggcaactccaggggttaagcatggccagcccatttcacagatggggaaactgagggacagagaagctgagtggcttcccagggtcatgcaggtattagttatcacctgatgctatgtccaggcctctctgtgactgaggggcccaggaggggccatgagttgcaggaggggacagaaggcggggccagtgccgggggtagccaggaggctgggggaggatgcagaggaactctgccaggcctttgcaactgcccacatttgcccagccctataatggtgctacagatgcggataagagtccacccagctctaccaacagggctgatggtgggcctggggagagacactaactcagggggccatgccaggtggcctgggccgcagagctgtggagctgtgagcctggtcaggagaggctgtgtagctctgagagccaggcaggagctggcgaccctttggagagggtgctacaggtgccacagtgactaccgtcagtgctcggggctcttcagaaactaggtaggtatgagtgtgagctcacagggagactctggaaaactgagacttggggaggaatttagttcagcagaaaggaggggcaggtgcttcagggagggggaatgacagagggatggccctgacctaggggacaccaaggacccaggtgactaaggcctcagggacatcttggcaccatgaagaggccagtactcctcgtggcacagctctaggggcaccattcccatggccatgatcatatttctgtcactttaaaaattgtatgtggcaggtgcagtgagttacacttacattctgannancnactttgggaggccaaggcaggaggattgcttgaggctaggagtttgagaccatcctgggcaacatagtgagacctccatctctacaaaaaaattaaaaattagcctggtgtagtggcatgtccctgtagtcctaactacttgagaggattgcttgaacccaggaatttgagaccagccttggcaacatactgagaccttgtctctacagttaaaaatagtaataaattaggctgagtgcagtggctcgtgcttgtaatcccagtactttgggaggccgaggcgcacggatcacctgaggtcaggagtttgagaccagcttggccaatatggggaaacccgtcntcntacntaaaaataaaaaaattagctgggtgtggtggcgggcgcctgtaatcgcagctacttgggaggctgaggcaggaaaatcacttcaacctgggaggtggagattgcagtgagccgagatcacaccactgcactccagccagggtgacagagcgagacactctcaaaatataataaacaaataaaaataatatgagaataatgggatggccactttgggaagcagctgatagttcctcaggaagttaaacacagaatcaccatttgatctggcaattccactccttgttatatacccaagagataagaaaaacatgtccatcctaaaacttgtgcaggaatgttcatagcagcactatccacaacagccaaaagtggaaacaccccaagtgtccatccactgatgaatggatacacaaatgaagtctgtccctgcagtggaatatcagccctaagaaggagtgtagcaggtgcgtggaatatcagtcataagaaggagtgtagcaggtgcgtggaatatcagccctaagaaggagtgtagcaggtgcgtggaatatcagccctaagaaggagtgtagcaggtgcgtggaatatcagccctaagaaggagtgtagcaggtgcgtggaatatcagccctaagaaggagtgtagcgggtgcgtggaatatcagccctaagaaggagtgtagcgggtgtgtggaatatcagccctaagaaggagtgtagcaggtgcgtggaatatcagccataagaaggagtgtagcaggtgcgtggaatatcagccctaagaaggagtgtagcaggtgcatgctacactgtgggaggaccttggaaacaagatgctaagcgagagaagccagacacagacggccacgtgttgcaggactctatttctatgacgtgtccagaataggtcaacccacagaggcagagagtagatttgtggttgcaggagccaggggaagcttgaggnggnnnnnacatgggcagtgtgtagaatgtggtactatgaagttaaaaatgaataaatttgaactagaggaattattataacacggacagctgtcgaaaacacaacaaacgacacacacagtaggatactggtttgcgtatatatatgttttttcttctgatttgtcattgacttgaatttcacgcgtatatatccttgcaggaggatatgcaatctgaagccaaaatggtgtgattttttttttttttgagacagagtcttactctgttgcccaggctggagtgcagtggcgtgatctcagctcactgcaacgtctgcctcccaggttcaagcagttctcatccctcagcttcccaagtagctgggattacaggcatgcgccaccacgccaggctaatttttgtatttttagtagacggggtttcaccatgttggccaggctggtcttgaactcctgacctcaagtgatccacccaccctggcctcccaaagggctgggattacaggcgtgagccactgtgcccggcctatggtgtgacatttttaaaccagtttcaatgcccacctgccagatggacaggaattccagggtcacctgctgggttgcccagaaagcagagtcttacctgctgtgacagatggtctggtcaacttccacaggcaggcggggggccatctgggcagggcctgtccactgtaccacaagctcctccctgccacaggtggctgctgtgggtgctgctggacccctgcagctgggtcccacctgccagccgtgggccaggtcacgtggcctttcaaagacaggccgagctgtgggccactccctgtatctgagccacgcctcacccgagacctccacatctgtttcagacaccctgggtgagacacgacggctgctgctcggggctcctcaggggtccccgntctctgaaaggccccttcatggaccaggggcctcttcctcactaaagcagaggaaataagggcacagattagatggtaagaggggcacccctcagctgcatcctagacctggaagagagtgtgacctgtgccccagaagaaagggagggacgtatctagcggttgatgctgagggccaaagctagatgggtcaaggccttttgtctgcactattatttttatttgttttctttatttcttcctttcttttttgagacagtgactcactctgtcaccgggctggaatgcagtgatgcgatcacagctcacagcagcctcaaactcctgggctcaagcagtccttccccctcagcctcctgnnagtagctgggactacaggtgtgcaccaccacgcctggctagttgttttttgtattttttgtagagactgggttttgccgtattggccaggctggtctcaaactgctggactcaaacgatcctcctagctcggcctcccaaangtgctngggattacaggtgcaagccaccatgcccagctagcaccattatttttataaagctcatctctggtgatacttgccccagtttccccaggctggaagttgaccccaggcccagctcttgagggtttgatggaaaaccccaggagtagcagtgcctgtgacaatcgctgacatgtcgagttacacgtaatatccctgagctgcgcgatggctgcgtgtgacgcgctcagcagcctgtgcggtcgctcctgttgttatctccatttcatgcctgtgaaaatggcagtaactggcagcaacgtgctgtgccaccctgggcaactcccttctctggctgtcttatgtataaccagaaggggtttcttctcaaagccacaggcaagcagaaggcactgtgcagagggctcagaggtacacggcacagggcggctccatgagccccggtggccaggaccactgtcctgacagcaagggagggagagacgccacagggcgggcctcaggggctttgcagggtgggcttgtgccagagtagggtatgctcagggagggtgctgagggatttccccagagtggtcaggtgaggagggaagggcacttctggtagagaaaacagcagaacagagggcaacgctggcggaactgtccatggctgaaggtgccgaggctggagcctgtcgtggaagtctggtggctgagtgaggggtcaccagatgggcacaagttgtccaggctgagggtgcagagatcccaaaacaactttccttccaggggcttgtgaaggcagggcacgcaggacccttctgtccctgctcctcacccgtcaccaaacaggccaaggacagttcacagcagacacaatataccaatacctagagaaatggccaaggagcatagtaagtaactaaggaaatccgctgtctccgggtggcgggcttaggggaatccccccaaacttttttaaaatcaggtttattgaggtacaggttgagcgtcccaaagctgtaaatccaaaaccccaaacattccaagcaccgacatgacgctcaaagggaatgcttattggcgcgtttgggatttcagatttttgaatttttgagttagggatgctgaactggtaaatatactgcaaagattacaaaatatgaaaaaatccaaaattcaaaacatctggtccaagcatttcagataatggatcctcaacctgtatcattcatatccagtgagtttttcttttcttttctttttttagagacagggttttgctctgttgtccaggccaaagtgcagtggcgcaatcatagctcattgcagccttgaactcctgggctcaagcatcttcccacctcagcactgtgaatagctgggactacaggcatgcaccaccatgcccagctaatttttaattttttggtagagatggggtctcgctgtatcacccaggctgggacagtcttgtttccaccaccagaatcaacatagagaatatgaccccagaaagttccctggccccaggcaaccactcacctgttttctgtctcaatggtgttgccgtttccagactttcccatgaaacagtcagatagtgtgttgccctgtgagtccggcttctttcacacggaggaatgcgtttgagattcatctgtcagttgcatgtaccaggagtttggtcctttttgttgctaagtggtcttccattgtgtgggtaaaccacaagtttgttgttgatgagttccccagttgaagggcgtgtggttgtttgcaatttttggtgatggtagaaagctgcaatgaacaggtttttgtgtggacatatgtcttcatttctctctcctaatcccaacttttgtccacatgcattttctagtgcttctgtaataaaccagtattatttatgccatgaaagtcacaattttaaaatatgcaaagtaaagcaactatgagatatcattttctgcctctcaaaccagcaaggagtttttaaatgatagcattcagctttgtcgcaggctactgtgtgtcaaccatgcagcctttctggagaggaactgggcagaataagctggacatgggcgtgtctttgggcggtgccttcacttctagggatgcaggttaagctggacatgggcgtgtctttgggcggtggcttcacttctagggatgcaggtattcgctggacagatgtttgttaagctccctggtgccaggcccagggagttggtcgtgggtgagaccccagagaccccagagcacattcagcagggacaaggcaattgtcatgcaattatctatgcaggaacagggtgagaagctttgcaaagaagttggggacctcttgtccccttctccagcctgcacatgacctccctgtcatagagaaaggagtctgagcctggctttcaagcaccacgcttgtgcttgcaggctgtgtgaccttgggcaagtcactccccctctntgagcctcagaggaagacagctgttctgcatcagagcctaaggccttagtggctgtggagggaagaacatctaggtggcctncncgtgtngactgcacaaaaggtcttgtccttcctcaaagctccaatggaggtagtggtgatggatgtacaactctgggagtctactaaaggctactgcgttttacacttcagaaggatggattttatggtatgtgaattatatctcaataaatctgctattttataaaagaagcttgaggccgggggtggtggctcacgcctgtaatcccagcactttgggaggccgaggcaggtggatcacctgaggtcaggagctagagaccagcctggccaacatggtgaaaccctgtctctactgaaaatacaaaaattacctgcgcatggcggcacatgcctgtagtcccagctacnntcntggaggctgaggcaggagaatcacttgaacccgggaggcagaggttgcagtcagcca

SEQ ID NO: 739 - DNA, 10304 bp, Homo sapiens
aaaatgatattttgggagatctacaatccgtttagaatttctggtgaattcctgaagggagaggacaacagataaagctactgatgaggtcagcaggagaggtttgtctaccaccctaaggcattgagacctaattccaaaggttgtcaggaacatgggactatcaaaagcagtaggggtgtggtgaagtgggatatgatccaaaatcagacttgctgattgggaataccaccccagcagtagtgaggaaggataggtttagagtgtgagctggaaatagagagacagattaggaagtgactgcaatcagacaggcaagagattatgagggacccctttaaggaattaacagtggacacagaaaggatttaagagcactgcagaacttggagagtcactggatgttgggaatagaaaggaagcaagctaaggatctcttcagggttcttgacttataaaatcaggccacaaaaagataggtgggacaacagagatgaaagatggtaagttatttttggagcatgtttcattagagataggctgacttcctgggtaaaaagtcctgtacttggcaatgtggagtctttacttactaagaagtttgaagctcgcaagtgttagtggaagttgtggatgtgatgaagacatggcgggaaaggacaaatccaagaaccaacggaagggctgagcacagaaccttgaaggatcaatcacagtagaggtgggaagaagaggagcctgaagagaagagcagagatgacatgactagagaggcaggaagacactcatctagagccacatcacagaaacaaaattgccacacctttcctggactgtcatccgggaaattcctactcatttcttcttcaaagttcaactcaagcacttccttctctgggaagctttccttgactgcccccttccatgtaaaagcctgtttccctttgctgccaactgctacttgtgtacaacttgaactttaaagaaagtaccccttcatatctttctgtctgaacgcccgtcttaatgcttcgctgtaagcaccttgggggtcccatatcacattgctcaccagagggcttggcctgtagaagatgcctaatacatatttgctgagtgaagccctgtaggaaacattgagtatcattaagacttcctcagaagagccactgcaaaatctgtgccaactgttgatgcttctagaacacagacttactttcagttttccaaataacccatgttggtctcaatgaaagccttcctattaattaccttctgaagtcctaatcttatttcagaggccaattacatcttccatgggtatattttcactaccaacccagagatcaaaccaccatcaaagcccccgagtcctgagttaatcatccttctatacaaactttcttatgcatatttttttattgcatagaccaatgatatgctcatctctgtgtcttacatcaggatgaccagactatgagcttttcgattgaaagaccaatgtcttgaagatctgtggctccagcagttatcacagcagccaagcatttggtaaaaccttgggaaatggaagaggaattagatggtgccttgatttctggccatcaaacaggccaccatcagagggcactggcggctctatcaggctgagattgcttgaggtgttcccacagcctgaatcataggccatttgtgatggaactgtaactccaatctggacttctgcattttttccaggcagcgggatagggggtgcatgctcttacttctggatcagcttctctgctccgaatgccttactggattttaaactactctctctgtctccatgctaagttacagcctgttctccttaccacatcagaggtgtgtctaagaaacagctctgctcaaagcatgttatacaaggtttttcacaattgcctcaacctgcctttacagttgtatatctgccaccagtcctggtttaccaccacactgtcaatacaaaattctctgctgtttcctgaatagaccacagatgcccccacactagtgctcttagcttaggctgtttcctcttctgcaaattcccttctccacctctaagagttctaacttgtcatgcaaggcttttgtattatctacttgataaagagttctctaatcatccaggtagagtttttctctctgcattatgttgcaggcttttaagaatgtacctttattatggcacttatcacactattcatatttatttgtttgcttattcctcttccatagtttaatattctcactttgagggcaaatattaaaaccttcaaagaaatctacaggctgtttacttgcaattaaaaatgtctgggccagttgcggtggctcacacctgtaatcccagcatgttgggaggccgaggcgggcagatcacttgaggtcaggaattcgagaccagcctggccaacatggtgaagccccatctctactaaaaatacaaaaacaaattagccaggtgtggtggcaggcgcctgtagtcccagctacttgggagggtgaggtgggagaattgcttgaacctgggaggcagaggttgcagtgagccaagatggtgccattgcactccagcctgggtgacagagtaagacttcatctaaaaagaaaaaaaaaagtctggaaagataaaaatcctgacatggtcagtaaatacatccacaaggccaggctagatcttaaggaagctctcctacttggagtcacaagacagaaacttgcaggtacattatttacagattaataaaatccttcagtggctcaagtttatctatgcttagattgcaaacagacagcatttgattcacagtcctgtcttcctcatccacaatagacattactaaataccatgagaggcaggagtctgtaggccctccagattaattttatttgctgttttggcctataagataaaagtcaaactcctaagcaaaacatacagggttattataccttagatataccatgctgttgtatatcccaggcttttgcatacactgtccccactacctccaatctgtgtaccttcacccagtcccgtttttcctatcaaccatttagttcatctagtatactcctatgtcacctttacaattccactcaaacctcacctcctctgtgatgcccaccttcactttcatgagaagacttgggcttttcctctctatgcccatggtgtttctgaatacttctgctacttatagttataaatcacttataattgtctattgccttattgttttccctttgagactgtagttgttgattgtaggttctgtgtcttatctccatagctttagaatatgacacagtgtctgtttattatttacaagctcacactgagttctcctggaggtgggcacaaagtaatgtacaaatagaacatagaaatccaaacagatgtcattagggaagcttgtgtgcaggtagaaagatcacagccactaagattttgctctggataataaagccttatctccagagaggcaggactgtctgagtgaaacgaaactcttcgtaggaaggatctagaaaatcatgaagacttctagaacaagaatgaaaatggaagccaaaataaaaatggaagcccttttctataaaatggaacattagtggaaactcatgcatgagttccaatcatcatcagaagaatgaacctcaaaagttcataaatcttgaattatagctgctctgtaactgtacaagaaagaaaaatacaatgccatagtgggaggttgtgggagccacaggaagtggctcaagagattgggtggtagacaagaatgaatgggcccagctataagaagctgggtgtattaggccgttcatggttcccagaagctggttccccagaagccaagcagatgccagtgccatgttttaaagcctgccgaaccatgagccaattaaacctctttttttaaataaatgagccagtctcacgtattacagcctgcagtacattccagtgccatgcttgtacatgctttactcataacggaaggcaaaacagaaggcacttcatatggcaaaagcaagagcaagagagactgtatgtgtgtcggggcaggggtggtatcacactttacaacaaccaaattttgcaagaactcactcactatcatgagaactgcaccaagtcctggggacctgcctccatgcatgacaaaaacaccttccatcaggccccatctcctacattggggaatacaattcaacatgagatttgggcatggacaaatatccaaactatatcattccacccctcttctccacccctaaatctcacatccttctcatgctgcgaaatacagtcatgacttctcaatagtacccccaaatcttaacttgctctggcattaattcaaaagttccaagtctaaagtctaagtccaaagtttcatctggagataagttccttccacctataagcctgtaaagtcaaaataatttatttacttccaagatacaatgtgagtacaagcattgggtaaacattcccattccaaagggggaaaattggccaaaagaaaaaggctacaggctctatgcaagtttgaaacccagcagggcagtcaataaatcttatagctccaaaatagtctcatttgactccatgccccatatgctggacacagtggtgcaaggtgtgagctcccaaggcctttggcagctctggcctgtagcttcgcagggttcggtccctgtggttgctgtcatgggttggagttgcatgtctgtggctcttctacactgagggtgcaaagtgccagtggttcttccattcttgggtctggaggatggtggccctcttcccacagctgcactaggcaatgccctggtggggattctgtgtggggactcctatgccacatttcctctctgcactacttgaatagaggttctctgtgagggctcactctgataagcagcttggacatccaggcttttctacatgttccctgaaatttaggtggagggtgccaagcctccaccactcttgcactctgtatacctgcaggcttaacaccatgtggaagccaccaacacttatggcttgcaccctctggagctgcttcctgagctactcctgggcccctttgagccatggctagtgctggagcagccaggatgcaaggagcattgtcctgaggttgtgcagggcagcagagccctgggcctggcccacaaaatcattcttccttcctaggtctttgatcctgtgatgggctgtctcaaaagtctctgaaatgctttcaaaattgttttcctattgtctcggctattagcacttggctcccttttatttatgcaaatttctctagcaagtggtttctctgcaggctgcttggattcctctccagaaaaatgctttttctttccctgccacatggctaggctgagaaatcttctaaacatttatgctctgctttccttttaaatataaattcaattttaagtcatttctttgctctggtatctgaacataggctgttagaagaactcagaccacatcttgaacaatttgctgcttagaaatgtcttccttcaatctagataccttaggttgtcactctcaagttcaaacttccacagattcctaaggcatggatacaatacagccaaattctttgctaaggaataacaagggtgacctttgctccaggtcccaataattcctcatttcagtctgaaatctcctcagcctggattttattgtccatatcactatcggcattttggttacaaccatttaatgggtttctaaaaatttgcgaagtttacctcatcttcctgtcgtcttcttctgagatgtcgaaactcttctaacatcttcttgtcacctagttccaaagctgcttccacatttttgggtatctatctttatagcaatgcctcacttctaaatatcaattttctgtattaggccattgttgcattactctaaagaaatacctgagactgggtaatttattttaaaaaaaggttcagttggtccatggttctgcaggtcacacaagcatggttctggcatctgtttggcttttggggaggcctcagggagcttttactcatggtggaagatgaagtgggagaaggcacttcacataacaaaagcaagagcaagagagacagtagggggtgggtaggtgccacacttcgcagcaaccagatctcatgagaacttgctcaccatcatgaggacaccaccaagccatgatggatctgcctggatgaaccaaatacctcacatcaggccccatctccaacactggagattacaattcaacatcagatttgagcagggacaaatatccaaactatataactggagaagcctctgccagagttttgagatagggctgacagcagagactatgtccatgtcggtattcctggtattgagttcataacaaatgctcaagaaatgcttgttgaattgttaagtcatgattttttcaccatgggccccttggtgagagaactgaaaccaatgattagtcccaaatcatttgagaagggtagaggaaagcaaaaatgaggagagcctgaagtcacactaagaattttaatgtgaatgcaaaccttattacctaatgagctagaggcatacattagatgcagaaatatcaaccttcctctatcctgagctggacttgcaatttttttttaatcttagggcttttataacctgaaatgggtacaactactaaatccatatctagggtcattcaattttcaaggtgctattttagcttaccaaaagttaaagtatgctctcccctcccacattccatttgagaagtctatctgtcagattaagatactttcatcaaggtcactagactgcttgtcaaaagtcttttaacgtcagtcactccaagaattataaatagctttggcctcaaacacgattgtgttgagggaagggagggaagaaaaggagaagaagtgtgacagttgactttttaaaagccattgacatattaaagctttgaattgcttttaaaatttttctttcccatgagtttgaggtttattggacacgttgatctgaatgggcacgggcctctgctgagaaagttgtgggagatggtcggtgtttttcttggtttgtatgttcatattgtccttcctgaaatggttaggggcatttctcttgaagaactattaatagtctacatttttaaatcttgtaaacagttgtgcataactgatggtgtttccctctgtaatagttacgtataagctttgtgtcaaaattttgcttgacttcttactagagtgagacatttttcaaactgaataaaaataatgaccattactgaacactgactatgttccaggtactggactaagcactgagcatacagctattgctcgcaacttataataacaaatgaataaaattctacctttggtctccatttacagatgacagaagtaagacttggagaaattaagtaagatgaccaaaagttaagtcagacctcattctatttgacgccaaggtttgtgtagcatatatgacatctagaccacaaactccaatgtatatgaaatagctcattttttataaaattaacaaaaattgttctcatagtctattttgctagagtggtagagaattcagttgaagtcactactgggacttgccacaccatagagttgtgctgaattcctaaagttagttatagggagtgccacatcatctgagatgtagtcattggtcctttgtccactgggtaccattaagaatctctctgttccagactgtgtgatcctttccactaacacataacacctccctggggtggtattttgctactgagaaatgcctgggcccttgactttgaccctctttttggttcaggaggcatagctccctctttccaagcttctgaaagtattctctctatcctgcatcctcaggataatagtagcatagtcttttcaagaagttctaatatgacaaaaaaaaaatctcttttaagtgtcttttggttttccaccctgtaaaaatcctagaggcagagcagttctaaaattccagttgtgaggtaggaaaatataggaagaataaataagctaatattccacaaattattctgctatgtgccttctttctttaggtttaccaggtatagtttggtctgaataggtatggtccattgatggaacataatgagctttgattattgtgtcttttctttgcaaatctattttctagcacccactgccagaaatggttgtatttcttagaaaccatggtttatttttatttcatgggcacggtgagtcatataatagactacatttccctttctgcaggttttttggagacattttgatcagatatgtgtctgtgtactctgacattcttacaacgtattttctagactaaattgtataaaatttagagagatttgttttgtttattttattttaattttcataggttttttgggggaacaggtggtgtttggttacatgagtaagttctttagtggcgatatgtgaggtgctttttttttttttttgagacagagtcttgccctgtcacccaggctggagtgcaatggcactatctcggctcactgcaacctctgcctcccgagttcaagagattctcctgcttcagcctcctgagtagctgggattacaggcacgcaccagcatgcctggctaattttttgtatctttagcagagacagggtttcaccatgttggccaggagggggttttggtgcttttaaaatactatgtattattatatatgtcaggacctgggagggaagatacgtaatgaaagtggtctcttgtttggtctcttcttaaaattttaacctttctgttttgaaaacatctagcttccagatttttatgtttcataaagaaatatagcattattactaataatagtacttgttttagacctgatgttacaaataccaaaaaacaaacatacaaacaaacaaacaaacaaaactttgtgtctctttaagtatttgtttttcttcaatggaatttggggaagaaggttgcaggtcagaccaaggaagtggagctggggccaaactgcagcaagcagagctcagtgcagaactgcatgtactcacacttcctcagcccctaggcagaatggcagacctgagcttccccacccttcaggaccggagagaattgaatttatttctacttaagttccagtaggttgccatgctgtctgtgggcactcaataaatattgactcaattgcgtgttgccatgggttatcttcctttctctcttttccctccccagctcctctggctggttccttgggtttttaaaagttatatacattttttcagtgtttcatttgtttttatgtcattggttttcagtgttaggcctctctgtgttctaaatattacttctttgtgtttgttttctctgtctggttcttgcctcacaacttgtctctgaatctgcccttctttgttttctttctttgagactctgtttctgtatttctcctttctatctctttatgtctctccttctgtctctgtctctctctctgaaacttccccatacccctttctatacttctgtttgttcccttccagaactgtcatcaaatcattgcattttcccaggagaaattgaacacactaacagatttgtataagtgttcagaataattcattttatgttttttttttatttgaaacagcagtttcagtccctaaatataggaacttgggaaaagtagatcagtgtctatgttgaccataatacattctaaatcatacagagtgattgaatcagctctcctttgggttttctatttgccttctgcccagacaggattgcattcctctgcgcattctgacacaaatgcagtgacatttcaccaggcaactattagcctagggggaatattcagcttctcccttcccctagtgttttaaacctcattccaataatttggcctaagatgttggcacagaaatactggttgcaaaaagtccttggagactgatgctgactttctgccttctatgtctcaattttagggacaaaaatgagacatgggtttgcaatggctttccttcagccactttctggttaagatctgaagggtgtgatcaacctccctggggtttgacaggttactgtcctgctgttgacattaaaattaattctctaaacatcatttgtgcctagaaaggtaacaaactaatcagtacttaagcaagtatatggaggattgaacttttaaagtggca

SEQ ID NO: 740 - DNA, 15308 bp, Homo sapiens
aaatccttcagtggctcaagtttatctatgcttagattgcaaacagacagcatttgattcacagtcctgtcttcctcatccacaatagacattactaaataccatgagaggcaggagtctgtaggccctccagattaattttatttgctgttttggcctataagataaaagtcaaactcctaagcaaaacatacagggttattataccttagatataccatgctgttgtatatcccaggcttttgcatacactgtccccactacctccaatctgtgtaccttcacccagtcccgtttttcctatcaaccatttagttcatctagtatactcctatgtcacctttacaattccactcaaacctcacctcctctgtgatgcccaccttcactttcatgagaagacttgggcttttcctctctatgcccatggtgtttctgaatacttctgctacttatagttataaatcacttataattgtctattgccttattgttttccctttgagactgtagttgttgattgtaggttctgtgtcttatctccatagctttagaatatgacacagtgtctgtttattatttacaagctcacactgagttctcctggaggtgggcacaaagtaatgtacaaatagaacatagaaatccaaacagatgtcattagggaagcttgtgtgcaggtagaaagatcacagccactaagattttgctctggataataaagccttatctccagagaggcaggactgtctgagtgaaacgaaactcttcgtaggaaggatctagaaaatcatgaagacttctagaacaagaatgaaaatggaagccaaaataaaaatggaagcccttttctataaaatggaacattagtggaaactcatgcatgagttccaatcatcatcagaagaatgaacctcaaaagttcataaatcttgaattatagctgctctgtaactgtacaagaaagaaaaatacaatgccatagtgggaggttgtgggagccacaggaagtggctcaagagattgggtggtagacaagaatgaatgggcccagctataagaagctgggtgtattaggccgttcatggttcccagaagctggttccccagaagccaagcagatgccagtgccatgttttaaagcctgccgaaccatgagccaattaaacctctttttttaaataaatgagccagtctcacgtattacagcctgcagtacattccagtgccatgcttgtacatgctttactcataacggaaggcaaaacagaaggcacttcatatggcaaaagcaagagcaagagagactgtatgtgtgtcggggcaggggtggtatcacactttacaacaaccaaattttgcaagaactcactcactatcatgagaactgcaccaagtcctggggacctgcctccatgcatgacaaaaacaccttccatcaggccccatctcctacattggggaatacaattcaacatgagatttgggcatggacaaatatccaaactatatcattccacccctcttctccacccctaaatctcacatccttctcatgctgcgaaatacagtcatgacttctcaatagtacccccaaatcttaacttgctctggcattaattcaaaagttccaagtctaaagtctaagtccaaagtttcatctggagataagttccttccacctataagcctgtaaagtcaaaataatttatttacttccaagatacaatgtgagtacaagcattgggtaaacattcccattccaaagggggaaaattggccaaaagaaaaaggctacaggctctatgcaagtttgaaacccagcagggcagtcaataaatcttatagctccaaaatagtctcatttgactccatgccccatatgctggacacagtggtgcaaggtgtgagctcccaaggcctttggcagctctggcctgtagcttcgcagggttcggtccctgtggttgctgtcatgggttggagttgcatgtctgtggctcttctacactgagggtgcaaagtgccagtggttcttccattcttgggtctggaggatggtggccctcttcccacagctgcactaggcaatgccctggtggggattctgtgtggggactcctatgccacatttcctctctgcactacttgaatagaggttctctgtgagggctcactctgataagcagcttggacatccaggcttttctacatgttccctgaaatttaggtggagggtgccaagcctccaccactcttgcactctgtatacctgcaggcttaacaccatgtggaagccaccaacacttatggcttgcaccctctggagctgcttcctgagctactcctgggcccctttgagccatggctagtgctggagcagccaggatgcaaggagcattgtcctgaggttgtgcagggcagcagagccctgggcctggcccacaaaatcattcttccttcctaggtctttgatcctgtgatgggctgtctcaaaagtctctgaaatgctttcaaaattgttttcctattgtctcggctattagcacttggctcccttttatttatgcaaatttctctagcaagtggtttctctgcaggctgcttggattcctctccagaaaaatgctttttctttccctgccacatggctaggctgagaaatcttctaaacatttatgctctgctttccttttaaatataaattcaattttaagtcatttctttgctctggtatctgaacataggctgttagaagaactcagaccacatcttgaacaatttgctgcttagaaatgtcttccttcaatctagataccttaggttgtcactctcaagttcaaacttccacagattcctaaggcatggatacaatacagccaaattctttgctaaggaataacaagggtgacctttgctccaggtcccaataattcctcatttcagtctgaaatctcctcagcctggattttattgtccatatcactatcggcattttggttacaaccatttaatgggtttctaaaaatttgcgaagtttacctcatcttcctgtcgtcttcttctgagatgtcgaaactcttctaacatcttcttgtcacctagttccaaagctgcttccacatttttgggtatctatctttatagcaatgcctcacttctaaatatcaattttctgtattaggccattgttgcattactctaaagaaatacctgagactgggtaatttattttaaaaaaaggttcagttggtccatggttctgcaggtcacacaagcatggttctggcatctgtttggcttttggggaggcctcagggagcttttactcatggtggaagatgaagtgggagaaggcacttcacataacaaaagcaagagcaagagagacagtagggggtgggtaggtgccacacttcgcagcaaccagatctcatgagaacttgctcaccatcatgaggacaccaccaagccatgatggatctgcctggatgaaccaaatacctcacatcaggccccatctccaacactggagattacaattcaacatcagatttgagcagggacaaatatccaaactatataactggagaagcctctgccagagttttgagatagggctgacagcagagactatgtccatgtcggtattcctggtattgagttcataacaaatgctcaagaaatgcttgttgaattgttaagtcatgattttttcaccatgggccccttggtgagagaactgaaaccaatgattagtcccaaatcatttgagaagggtagaggaaagcaaaaatgaggagagcctgaagtcacactaagaattttaatgtgaatgcaaaccttattacctaatgagctagaggcatacattagatgcagaaatatcaaccttcctctatcctgagctggacttgcaatttttttttaatcttagggcttttataacctgaaatgggtacaactactaaatccatatctagggtcattcaattttcaaggtgctattttagcttaccaaaagttaaagtatgctctcccctcccacattccatttgagaagtctatctgtcagattaagatactttcatcaaggtcactagactgcttgtcaaaagtcttttaacgtcagtcactccaagaattataaatagctttggcctcaaacacgattgtgttgagggaagggagggaagaaaaggagaagaagtgtgacagttgactttttaaaagccattgacatattaaagctttgaattgcttttaaaatttttctttcccatgagtttgaggtttattggacacgttgatctgaatgggcacgggcctctgctgagaaagttgtgggagatggtcggtgtttttcttggtttgtatgttcatattgtccttcctgaaatggttaggggcatttctcttgaagaactattaatagtctacatttttaaatcttgtaaacagttgtgcataactgatggtgtttccctctgtaatagttacgtataagctttgtgtcaaaattttgcttgacttcttactagagtgagacatttttcaaactgaataaaaataatgaccattactgaacactgactatgttccaggtactggactaagcactgagcatacagctattgctcgcaacttataataacaaatgaataaaattctacctttggtctccatttacagatgacagaagtaagacttggagaaattaagtaagatgaccaaaagttaagtcagacctcattctatttgacgccaaggtttgtgtagcatatatgacatctagaccacaaactccaatgtatatgaaatagctcattttttataaaattaacaaaaattgttctcatagtctattttgctagagtggtagagaattcagttgaagtcactactgggacttgccacaccatagagttgtgctgaattcctaaagttagttatagggagtgccacatcatctgagatgtagtcattggtcctttgtccactgggtaccattaagaatctctctgttccagactgtgtgatcctttccactaacacataacacctccctggggtggtattttgctactgagaaatgcctgggcccttgactttgaccctctttttggttcaggaggcatagctccctctttccaagcttctgaaagtattctctctatcctgcatcctcaggataatagtagcatagtcttttcaagaagttctaatatgacaaaaaaaaaatctcttttaagtgtcttttggttttccaccctgtaaaaatcctagaggcagagcagttctaaaattccagttgtgaggtaggaaaatataggaagaataaataagctaatattccacaaattattctgctatgtgccttctttctttaggtttaccaggtatagtttggtctgaataggtatggtccattgatggaacataatgagctttgattattgtgtcttttctttgcaaatctattttctagcacccactgccagaaatggttgtatttcttagaaaccatggtttatttttatttcatgggcacggtgagtcatataatagactacatttccctttctgcaggttttttggagacattttgatcagatatgtgtctgtgtactctgacattcttacaacgtattttctagactaaattgtataaaatttagagagatttgttttgtttattttattttaattttcataggttttttgggggaacaggtggtgtttggttacatgagtaagttctttagtggcgatatgtgaggtgctttttttttttttttgagacagagtcttgccctgtcacccaggctggagtgcaatggcactatctcggctcactgcaacctctgcctcccgagttcaagagattctcctgcttcagcctcctgagtagctgggattacaggcacgcaccagcatgcctggctaattttttgtatctttagcagagacagggtttcaccatgttggccaggagggggttttggtgcttttaaaatactatgtattattatatatgtcaggacctgggagggaagatacgtaatgaaagtggtctcttgtttggtctcttcttaaaattttaacctttctgttttgaaaacatctagcttccagatttttatgtttcataaagaaatatagcattattactaataatagtacttgttttagacctgatgttacaaataccaaaaaacaaacatacaaacaaacaaacaaacaaaactttgtgtctctttaagtatttgtttttcttcaatggaatttggggaagaaggttgcaggtcagaccaaggaagtggagctggggccaaactgcagcaagcagagctcagtgcagaactgcatgtactcacacttcctcagcccctaggcagaatggcagacctgagcttccccacccttcaggaccggagagaattgaatttatttctacttaagttccagtaggttgccatgctgtctgtgggcactcaataaatattgactcaattgcgtgttgccatgggttatcttcctttctctcttttccctccccagctcctctggctggttccttgggtttttaaaagttatatacattttttcagtgtttcatttgtttttatgtcattggttttcagtgttaggcctctctgtgttctaaatattacttctttgtgtttgttttctctgtctggttcttgcctcacaacttgtctctgaatctgcccttctttgttttctttctttgagactctgtttctgtatttctcctttctatctctttatgtctctccttctgtctctgtctctctctctgaaacttccccatacccctttctatacttctgtttgttcccttccagaactgtcatcaaatcattgcattttcccaggagaaattgaacacactaacagatttgtataagtgttcagaataattcattttatgttttttttttatttgaaacagcagtttcagtccctaaatataggaacttgggaaaagtagatcagtgtctatgttgaccataatacattctaaatcatacagagtgattgaatcagctctcctttgggttttctatttgccttctgcccagacaggattgcattcctctgcgcattctgacacaaatgcagtgacatttcaccaggcaactattagcctagggggaatattcagcttctcccttcccctagtgttttaaacctcattccaataatttggcctaagatgttggcacagaaatactggttgcaaaaagtccttggagactgatgctgactttctgccttctatgtctcaattttagggacaaaaatgagacatgggtttgcaatggctttccttcagccactttctggttaagatctgaagggtgtgatcaacctccctggggtttgacaggttactgtcctgctgttgacattaaaattaattctctaaacatcatttgtgcctagaaaggtaacaaactaatcagtacttaagcaagtatatggaggattgaacttttaaagtggcatggacagactgtaaaaaaggcctgtgtccttgttttaggagaagaatacaatttcttttttcttctttttattttttaaatttattttaggtttagaggtacatgtgtaggtttgttatacaggtaaattgcacatcacagaggtttggtgtacagattatttcatcatccagataatcaacagagtacctgataaggaatttttcaaatctctccttcctcccaccctccagcctcaagtaggacacagtgcctgatattcctttctttatggtcatgtgtacccagtgtttagctcccacttataagttaggatgtggcatttgggtttctttttctgcattagtttgcttaggattatggcctccagctttatccatattgctgtaaaggacatgatctagttctttttatggctgtgtaatatgttgtatatccatccatgggcatttaggttgattccatgtctttgctactgaatatagtgctgcaatagacatacgcacccatgagtctttatggtagaatgatttatattcctttgggcacatactcaataatgggattgctgggttgattgataattctgttttaagttctttggggaatcactgcagtgctttccacaatggctgaactaatttacattcccgccagcagtgtataaacgtttccttttctccacaaccttgccagcacctgttgttttttgacattttagtaagagccattctgactggtatagatggtatttcattgtggtcttgatttgcctttctctgctggttagtgatgttgaacattttataatatgcttgttggccatgtgtatgtcttcttttggacacagtctgttcatgtccatgcctactttttaatgggttttttttttttttgcttattaatgtgtttaagttccctgtagattctggatattagacctttgttagatgtgtagtttgcaaacattttctcccattctctaggttgtctgtttagtcaattgatagtttcttttgctgtgagaaactatcaattgaataaacagataaactagagaatgggagaaaatatttgtccagttttgtttttgttgcaattgtttttggtgtcttcataaactatctgccagagcctatgtccagaatgatgtttcctaggttatcttccagggttttcatgttgtgggttttacatttaagcctttaatccatcttgagttgatttttgtatatggtataaagaaggggtccacattcaatcatctgcgtatggccagcaagttatcccagcaccatttattgaatagggagtcctttccccattacttgtttttgtcaactttgtcaaaaacaagatgcctgtaggtctgtggctttacttccgggctttctattctgttctattggtctatgtgtctgtttttgtatcagcaccctgcccttttgattactgtagccttgtagtatagtttgaagttgggtaacgtgatgcctccagctttgtactttttgcttagaatggccttggccattcaagctcttttttggctccatatgaattttgaaacaattttttccaattctgtgaagaatttcattggtagtttgatagaaattgcattgaaactgtaaattgctttgggaagtgtggtcattttaacaatattgattctccctatccacaagcatggaatgtttttacatttgtttgtgtcttctctgatttctttgagcagtgttttgtaattctcattatggagatttttcactccctggttagctgtattcctagatattttattctttttgtggtgttgtgaatgggattgcattcttgatttggctctcagcttggacattgttggtgtatagaaatgctactgatttctgtacattgactttgtatcctgaaactttgctgaagttttttatcagatctaagagctcttgggaagagactatgggttttttcaggtatagaatcatatcgtctacaaactgatatagtttgacttcttctcttcctatttggatgccttgtatttctttatcttgcctgactgctctgtctaggacttccagtactatcttaaataggggtggtgagagtagatatctttgtcttgttccggttctcaagggaaatgcttccagcttttgccccttgaatatggtgttggctatgcgtttgtcatagatggcttttattttgaaatatgttcctccaatgccaagtttgttgagggtttttagcatgaagggatgctgacttttattggagagcttttttgtacctattaagatgatcatgttatttttggttttagctctgtttatgtggtaaatcacgttttaatttgtgtatgtttaactaaccttgcatcccagggataaagcctactacatcatagtggattaggttttgttgtgctgctggatttggtttgctagtatttcattgaagattttttatctatgttcatcaaggacactggcctgaagttttctttttttgttgtgtgtctgccaggttttggtattaggatcatgttggcctcatagaatgagttagggaggagtccctccccctcagttttttggaatagttcaatagaattggtaccagttcttcattacaaacctatggatgtcataggtttgtaagtctggtagaattcggctgtgaatccgtctggttctgggcttcttctggttggtaggctttttattactgattcaatttccaaacatgttattggtctgttcagggattcagtttcttcctagttcaatcttgggaggttatatatttccaggaattcatccatttcttctagattttctagtttgtatgcatagaggtgttcatcataatctttgaggtgtttttgtgtttccgtgggatcagtggtaaagtacccctggtcatttctgattgtgtttatttgaatcttctttccttttttctttattagtctagctcatggtctgtcttaataattttttcaaaagaccaactcctggagtcattgatcttttgtgtattttattttgcatctcaatttcctttcattttgctctaattttggttatttcttgtcctttgctggctttggggttggtttgctcttgtttctctagtttctctaattgtgatggtagttattaatatgagttctttctaacatttttatatgagcgtttaatgccataaacttcccccttaacacttccttagctatgtcccagagattctggtatattgtatcttttttcttattactttaaaagaatttcttcatctctgccttcctttcattatttacacaaaagtcattcagaagcaggttgtttaatttccatacaattgtattgttttgagtgattttcttagtattgatttatatttttattgtgctgtagtccgtgaatgtagttggtatgatttctgtttgttttttggtttgctgagaattgctttatgtcctattgagtggttgattttagagtatgtgctatgtgcagataggaaaaatgtatattctgttttggggtatagtgttctgtagatgtctgttcagtccatttggtcaaatgttgtgtccacatcttgaatatctttgttagtatttttgcctcaatgatatggttaatatggtcatggagtgttaaaatctcctagtattgttgtgtggttatctaaatctcttcataggtctgtaagtatttgctttatgaatttgggtgcacctgtgttgggtggatatatatgtaggatagtaaggtcttcttgttggattgaactctttgtaattatgtaatgcccttctgtccttctttttgttttttgtttgttttgttttgagacagagtctcactctgtcacccaggctggagtgcagtggcatggtctcagctcactgcaacctctgcctcccaggttcaagctattcttgtgcctcagcttcctgagtagctgggattacaagtgtgagccacagcatctggctaatttttgtatttttagtagagatggagttttcccatgttggccaggctgatggtcgaactcccaaactctaatgatcatcccaccttggcctcctaaagtgctgggattataggggtgagccacaacgtctagcctccctctttcttttttgatcattattggtttagtgtctattttgtctgaaattaaaatagttacccctgctattttctgttttccatttgcttggtaaatttttctctgttcctttactttgaatctatgggtgtcattgtctgtgagatggatctcttgaagacagcatacagttggatcttgctttcttcttcaccttgtcactctgtgccttttaattgaggtatttattctgtttgcatttaaggttgatattgatatgtgtggccaggtgcagtagctcacacttgcaatcccagcactttgggaggccgagtgggtggatcatgaggtcaagagattgagaccatcctggccaacatggtggaaccttgtctctactaaaaatataaaaattagctgggcgtggtggtgcgtacctgcagtcccagctacttgggaggctgaggcaggagaatacttgaacctgggaggcagaagttgaagtgagccaagattgtaccactgcacttcagcctggtgacagtgagattccctctcaaaaaaaaaaaattgatatgtgtaggttttatcctgtaatcatattgttagctggttattatgcagacttgattgtgtggttgctttatagtgtcaacgacctatatgctcaagtgtgcttttgtggtggctggtaacagtctttcctttccatatttagcactcccttaatgactgtgcaaggcagtaacaaattcccttagcatttgcttgtctgaaaatgatattatttctcctttgcttatgaaactagtttggctggatatgaaattcttggttggaatttcttttttcttttttttttttttaagaatgctgaggctgggcgaggcagctcaggcctgtaaccctagcactttaggaggccgaggtgggtgaatcacctgaggtcaggagttcgagaccagcctggccaacatggtgaaaccccatctctactaaaaataaaaaaattagccaggcatgatggcgggcacctgtaatcccagctattcaggaggctgatgcaggagaatcttttgaacccaggaggcggaggttgcagtgagctgagattgtgccacttcactccagcctgagtgaaagagcaagactctgtcaaaaaaaaaagaaaaaaaaaaaaaagaatggtgaatataggcccctaagtctcttctggcttgtagagtttctgctgaaagttccactgttagcttgatagggttccctttgtaggtgaccttccccttctctctagctgcctttaacattttttcctgcatttcaacgttggagaatctgacgactatgtgtcttggggatggttgtcttatatagtgtcttgtaggggttctctgcatttcctggatttaaatgttggcctctctagtgagattgggaaaatttttatggatcataacctcaaatatgttttccaagttgcttgctttctctccctttccttgggatgccaatgaattatagatttggtctcttggtctctttacataatcccatatttctcagaggttttatccattctttattgtttttgctttatttttgtctgacggagttatttcagagaagcaatctctcaagctctgagattctttcctcagcttggttgatggagctgttaatactggttgtattatgaaattcttaaagtgagtttttcacctctgttagttcagtttgattctttcttaaaatggccattttatctttcatctcctgtattgttttattacattctttagattccatggattaggattcaactttatcctgaatatcaatgatcttcatttctatccgtattctgaatgctagttctgacattttggtcattgcagccaggttaacaacctttgctggggaactagtgtggtcatttggaggtaagaagacatttttgccttttttgttgttgttgttgttgccagagttcctgcactgtttttgtctcatcaatgtgggctcatgtttcttcagcctttgaagttgcagtcctttggatgggctttttgcttttatcttttttggtgcccttgagggtttgattgtgattctcagtgggattagacaactggcttcaattatagtctgctcctgggtcttggaggagacccctccaattactgtctccatgactgtgtttcttttgttgggtgttctggtccacaggacttccttaggcagaggttgcagttagcagacaagccatttccttgctgggttggccctaatatgttgtttgagtgcttctcagggaaacataaggttgcacctgtctacagagtttaggcaaaagcagaaccactgagctggaagctctagcagatgtggcccatcttgctatgagaggcaggggtaggtggaattgcccaccctgccatctgggtgtttccagggcaacaggaagctgcacctccaacaaatttagacagaggtggaacctgtgaattggaaactctggcaagcattacccacttggcttccagtggtaggggttggtagggtcacccttcttgccatctcagtgtttctcaggaaaaaggcaggctttgcctgctagctgagttcaggcagaagagggttttctgggcttgaagatctagcaggcattgtcccccttggctaccattggcatgggtgtgtggtgtcacccaccctaccatctgggtatttctcaggacaacagaatgctgcactcttggctgagtttatgtagaagtgggactgttcggctggaagctctaacaggcattgtccacctggttatcagtggtggggatgggtgagatcacttgttctgccatctgggtgcttcctgggacagcaggaggctatggctgctggccaagttcaggcagaagcagcaccactgggctggaagctggtagtgagccctgtccaatgaaatgaggatagatcaatcttatttctcccagacactgcaaatgtggcctctattggagctatggtgacagtgctggtctgctttggggccaaaggcttgcagaggccctcttggactcaaaagttgcctccacaaaatgaccaggtggctctctacctcagtttattatcacagatgggagcgtggggggccagagggatttttccattcccagtcttgcataggtccctgtggagagtgcgaatcttctagggggctctcactcgctcaccctttaccatgtgggagaggttctcctggtttcacactaagccaagataggctggtgtccagctttgcttctctctgctctgtgtcccctgctgccttgatggatcccaatgtggtttctcagatgtttggcctgcagggtcagtgttcactagcccttttgtttcctttctgagagcagcacacgtgagctgcttctagtctatcatcttggaccctctaatctctttttctttgagctgacattattgagggccttacatgttccaacaactttatgcaaaatatctcaatccttacagcaaccctaaaagttaatatgatgatacccattttgtaggtgaggaaactgaagctaagagaagttaagtaacttgacagaggtcatacaaaatagcacagttgaaacttgt

SEQ ID NO: 741 - DNA, 6065 bp, Homo sapiens
tccctacacagaaatagttctttccctataaaattgagcaataattgaattcctacaggctttcggtgtttgaaattttgcttacagaatgatgatttggcatgtcgtctataattcaaacactccattacaaatgaaattaattgacatctcttaaaataggcagtgatatacatctgagtttttctaaaaagaactggaaacttactaattatactttaattaatagaaagtatttcaaacaaatttcctaaaagaaaaattgatcatctgtccctataaaaatacaaataattaattagtgtggattgccttcctttgttggaaaagaataccaatcttgccaattttttgatacagtaaatgagagaaaagaaactaagtacatgctgaaactaagctcagtctatgaacaatgaatcttggccatttttaaaaacctgaaaacaatactgactttcaagtaacttatcttaccataagatggcgatacttaagcactttataaaatgccatataagacctgtaagcttcagcgacagaaaaaaaaaaaaaagacacacaccgcattataaatgtaaacattatatagtcttccatgaaatagaattggcactgttgttagaaaacccagttgtcttcaggtaaactaatatataagaagtactttctaagatgtagatttccagtatttgatatatgtaaaatcctatacctaaaaaaaatctattcaattttaagagctttcccattttgccagtttctgtttatccatgtgaggtatatatattatatacatatataaaataaacaaagtataacaatatagaataatacttaaaattatttgaaaatttgatgatgacccatatcactccaaatgtattagtatgcaaaaaggcagttggttagcatttctgttcatttaagtgttatcacaaattatttcttatttgtccaaaaactgtattttttgtagtactatattattggatttttaattttaatttcaccatatataatttgctttatgaatcctgacttttaaaatctaagcccttaagtaactagtagaatgaaaaataaaattttacaaaattcttagtttataacctaattgacaattcttttgaggacacaatggtgccatctgtaattttttgggggggagcaatataaatatatattatataaatataaatatataatattaatacaaaagtagcttctcttcattttttaaagcaatgttttgtctaaaagtcctaaaactttttacaacattaaaattacttgttttgaaagttttaatattctctgtaatgtctatgatatagaacaaatatcgtcttttaaaaaaatcatcttttgttctttgcacactgtattgcagtatgtggaagctgagaaggacagtttgaaaagttaatgtatgccttccctggatttttcagctcatttgtagcaaatatccacagctcattctgaagaaagtaaaaagttttgtagcattgaatacacacaaataaactcaccaaaactagaaaagattatattgaccaaagatgcattgcttattttaaaaatgtcttcatatttaacagaaaattatctacatatttaattttggaaagaaaggggtgcaagcagtgaagatatttatgcatcaaagataacagacaaatcaaatcacacacaaaattgttaatgaagctctacatttctgaatttattttaaagaaaaacaaataaaactcactttaagtcaagtgactttttctgcagtaacttagtgattaactttgcttttagaaaatgttttaccaagaatattcccaaatcatatggaatgtattcaaaagttttaaacaatatcatataaaaagagtggcagtggatagaatgtgtcactacagggtgcagagtcaagaagaaaaaaaattaaatataaaaacaaaatcaacactttttcctaagtgtaaaatgctttaaagctacaccttagtatataaaatatgcctttaagattattaagatgacattcacacagagtgaagcgtttacatcaataataccagtacaatcaaagctttaaaataaaatgaatttattctcatcaggtccttctaaatatgaaagagtacagaaataattacaaatatatacgacatgattctaagttttaactgtatactatattaggcctacaaatatcacaaccacagtattaaattatgcttggttacatcttagttctattcagtaatgaaaggaaacttaatttgtctacactacacacatgatgtaaagctttaaaaataactttataatattccaaaatatagcttgtattagttttatagcatggaatcattcttcctatattgtcaaattgctgttggccagttaaataagtaaaataataaattgtatctcttactctttttcaccaggtggcttatctcttattccctgtcattatgattttcttagaaggctgaagctttcaaattatctcactttgtcatcaagacttttctcagacatcgttgaaaatatttgtccatattttcctgtctttttatcaaaggagtttagcgttcactttcattgccagtactagataattttcagagttcaacgtctatgagttaactcatccttcctattgccctccttagtttgttaaggttctcacttcctgtttcttaacactgataatcagaacttcctcagtgccccctaattttcttaatgaaaaggaagaaacaaacacaagctcctttcaccaacgcctctcagccatggcagagagtatagctctgctgctctgccatgtgttttacaagcagcatcccaaatgttttggacacaaaccgcagcacgtctgcgatgggagtattattgaccaggatcagctggaaaacgcttccctgctttcaacaaagaaacggttcaccatgtcctaatacatgtttataaattgcattgtttctactgcaaactcctttgcattacccgtccgacttcaaaagagagcattaagcagttggacacggaataagctaaattccccggagagccgcattgcccgctgcccatgcacattatattttctcctagtccctccccccgcgcagtaggactctaccttgaggagctattcctccggtagttcaccttgttatgttccaagcagtggggatacgccagacaccataaggtagctgaaagagctgtctctcgtcccgtttttgacatatttatttgcatttctgttaggtttgttacatattgcacatttatttcaaacaagactcaaaatattgttcataccttggaaggatctaatccggcaaacaaagacagcagcaggaggttgagaaggttggacgtcgcctgcattctgatctgggtttttgcccctctttactctcttttatgtaggctctccactcactgcagagacctttccctcgtcagttgcactttctgcctgccagtcagagccgagtggaagcagaggcggcggcagcagcagtagcaataacagcagcagcggcagcggcggcagccgccctggggggcgatcattccgcaggcattctcagagctaggagtccgggagctctagagagtgggttgggctgcagtgggcgctggccgcggtgctgaagcgcctccaacccgcgcgccccagtttaccctctcccccgctgctatatagctagcccacctcaaaagttttgacccaaggaatagataaagggattaactgctgagagaggtgtggagacctggacaacggatatgacatcactacagctcctgggggtttcggggggatattttgcggggaatttgttaaccaaacaaggattgactctcgtgctccagttcagcatttgccggcaacttgagctgcagagaagtaaagagtcagctaaatacaggattatgaaacaaatagtgcactagaaccttctgctgtcattgacagaggacttgatattgtatttagtgctttaaacaaagtttgcagtgcagactatcagtgtgtgtcatccaaggcacacgattttcagctgttattgatagatgaatgtggtaatttatagatatgtgcagtcatttatgaatagcttattaaagttatatgttttggttaggtattaatgtgtatctatctatctagggatttggtcatctaaaaacactatgcataaataaataaagaggcttatattcttcttttagttataaatggtatattccattagtgatccccccagctgaaatatcccccccatatgcacagccatacctggaaatatagtttttctatcagtctgacttgtgtttttacttgaagaagaattcactgatagatggatagcgggatgggaagagtgtttatttctaagctttcaaacacttctgtaatctagggctcaagaaaaggcagaatagctgcctcacaagagcaaagaaagggtaaatggcaaactctcttaccctgcatcattcaaccttactggagcaatttcatttctttgaatatggaaaaagtgttctcaataatataaaaaggaagaagttggtagccaccctgaaacatccctctcgtacaattatgcctgtaatatttccatcttctattgatttttctagaaattataattcctaagggttaaaatatatagatagactgggtctgtggacattgcttccttttacttcgacatttaaaagacaatgaattgagatatcagacacataccgagtatgaaatctccatcaacctttcactgaaaatatatcctattttttaatataagaaatctcaattaggactcaaatgcatttgaaagttattgtccccaagaatttacatcatattgcatctgttttaatcctaatattataaatgtgtgtatagttacttgaggtctttattttctataaacataaatggcatgaagttcactacatctgataattctttttgaaggagtggatcatacaaaatagagattgcaaaatcatagaaagaaagtgaaattacttataatggtgttaatttaataatcttaacagccataaccatatttagaagtttccattattttgaggtaatagataaaactatagagttgtaccactctctggggtaacttcctagaacatatttgtcagagtttttttctttttacatttgcttcttaacctaaacttttctacctatcaacatctacatacttatctatctatgtaggataaaatcagcataatttttaaaaaatcacacatagaaattgttgaaaattctgcatccatttttaaatatttcacatgactgtgcagattgaaaatgaatttgcagaggtgtgttggctgaatgattataataatacatttttattatccattctctaaatacattttttgttatttgtatttacacatgcttttccctcttcccaagaagtcttctaccatcttttttacatctctacctctcaattagcagacagtagtacattatacttgtttgagtagaggaagctgtatttaacagacacacacagtaatatgaaaatataataatatcaattttatcacttcaagataaacagatattcttataatgaaaataatgttttttttctggaaacagaattattctgatctcatacatggtttacaatattagtgactgtaccaaaacttttatgtgggcacagttttttttctctttaactctccttttttatggcactggaatgtcatttgtaacaagaagttaataagaaggcaaattctaattctatgaaatcttgtcagaaaaaatgtgatggaagaagatgataatatttagagatccaaaataagtaatatatggtaattatgttacaaatgaaaacagatgatcttagcaaacttacaacatattttccataagagaagcttagtcatttgtagagaataatcaagttcagtaatgaatcaaagctgtattaaacatgccactgaaaaacacaagctgtaatctaaacagtataaat

SEQ ID NO: 742 - DNA, 9671 bp, Homo sapiens
tccctacacagaaatagttctttccctataaaattgagcaataattgaattcctacaggctttcggtgtttgaaattttgcttacagaatgatgatttggcatgtcgtctataattcaaacactccattacaaatgaaattaattgacatctcttaaaataggcagtgatatacatctgagtttttctaaaaagaactggaaacttactaattatactttaattaatagaaagtatttcaaacaaatttcctaaaagaaaaattgatcatctgtccctataaaaatacaaataattaattagtgtggattgccttcctttgttggaaaagaataccaatcttgccaattttttgatacagtaaatgagagaaaagaaactaagtacatgctgaaactaagctcagtctatgaacaatgaatcttggccatttttaaaaacctgaaaacaatactgactttcaagtaacttatcttaccataagatggcgatacttaagcactttataaaatgccatataagacctgtaagcttcagcgacagaaaaaaaaaaaaaagacacacaccgcattataaatgtaaacattatatagtcttccatgaaatagaattggcactgttgttagaaaacccagttgtcttcaggtaaactaatatataagaagtactttctaagatgtagatttccagtatttgatatatgtaaaatcctatacctaaaaaaaatctattcaattttaagagctttcccattttgccagtttctgtttatccatgtgaggtatatatattatatacatatataaaataaacaaagtataacaatatagaataatacttaaaattatttgaaaatttgatgatgacccatatcactccaaatgtattagtatgcaaaaaggcagttggttagcatttctgttcatttaagtgttatcacaaattatttcttatttgtccaaaaactgtattttttgtagtactatattattggatttttaattttaatttcaccatatataatttgctttatgaatcctgacttttaaaatctaagcccttaagtaactagtagaatgaaaaataaaattttacaaaattcttagtttataacctaattgacaattcttttgaggacacaatggtgccatctgtaattttttgggggggagcaatataaatatatattatataaatataaatatataatattaatacaaaagtagcttctcttcattttttaaagcaatgttttgtctaaaagtcctaaaactttttacaacattaaaattacttgttttgaaagttttaatattctctgtaatgtctatgatatagaacaaatatcgtcttttaaaaaaatcatcttttgttctttgcacactgtattgcagtatgtggaagctgagaaggacagtttgaaaagttaatgtatgccttccctggatttttcagctcatttgtagcaaatatccacagctcattctgaagaaagtaaaaagttttgtagcattgaatacacacaaataaactcaccaaaactagaaaagattatattgaccaaagatgcattgcttattttaaaaatgtcttcatatttaacagaaaattatctacatatttaattttggaaagaaaggggtgcaagcagtgaagatatttatgcatcaaagataacagacaaatcaaatcacacacaaaattgttaatgaagctctacatttctgaatttattttaaagaaaaacaaataaaactcactttaagtcaagtgactttttctgcagtaacttagtgattaactttgcttttagaaaatgttttaccaagaatattcccaaatcatatggaatgtattcaaaagttttaaacaatatcatataaaaagagtggcagtggatagaatgtgtcactacagggtgcagagtcaagaagaaaaaaaattaaatataaaaacaaaatcaacactttttcctaagtgtaaaatgctttaaagctacaccttagtatataaaatatgcctttaagattattaagatgacattcacacagagtgaagcgtttacatcaataataccagtacaatcaaagctttaaaataaaatgaatttattctcatcaggtccttctaaatatgaaagagtacagaaataattacaaatatatacgacatgattctaagttttaactgtatactatattaggcctacaaatatcacaaccacagtattaaattatgcttggttacatcttagttctattcagtaatgaaaggaaacttaatttgtctacactacacacatgatgtaaagctttaaaaataactttataatattccaaaatatagcttgtattagttttatagcatggaatcattcttcctatattgtcaaattgctgttggccagttaaataagtaaaataataaattgtatctcttactctttttcaccaggtggcttatctcttattccctgtcattatgattttcttagaaggctgaagctttcaaattatctcactttgtcatcaagacttttctcagacatcgttgaaaatatttgtccatattttcctgtctttttatcaaaggagtttagcgttcactttcattgccagtactagataattttcagagttcaacgtctatgagttaactcatccttcctattgccctccttagtttgttaaggttctcacttcctgtttcttaacactgataatcagaacttcctcagtgccccctaattttcttaatgaaaaggaagaaacaaacacaagctcctttcaccaacgcctctcagccatggcagagagtatagctctgctgctctgccatgtgttttacaagcagcatcccaaatgttttggacacaaaccgcagcacgtctgcgatgggagtattattgaccaggatcagctggaaaacgcttccctgctttcaacaaagaaacggttcaccatgtcctaatacatgtttataaattgcattgtttctactgcaaactcctttgcattacccgtccgacttcaaaagagagcattaagcagttggacacggaataagctaaattccccggagagccgcattgcccgctgcccatgcacattatattttctcctagtccctccccccgcgcagtaggactctaccttgaggagctattcctccggtagttcaccttgttatgttccaagcagtggggatacgccagacaccataaggtagctgaaagagctgtctctcgtcccgtttttgacatatttatttgcatttctgttaggtttgttacatattgcacatttatttcaaacaagactcaaaatattgttcataccttggaaggatctaatccggcaaacaaagacagcagcaggaggttgagaaggttggacgtcgcctgcattctgatctgggtttttgcccctctttactctcttttatgtaggctctccactcactgcagagacctttccctcgtcagttgcactttctgcctgccagtcagagccgagtggaagcagaggcggcggcagcagcagtagcaataacagcagcagcggcagcggcggcagccgccctggggggcgatcattccgcaggcattctcagagctaggagtccgggagctctagagagtgggttgggctgcagtgggcgctggccgcggtgctgaagcgcctccaacccgcgcgccccagtttaccctctcccccgctgctatatagctagcccacctcaaaagttttgacccaaggaatagataaagggattaactgctgagagaggtgtggagacctggacaacggatatgacatcactacagctcctgggggtttcggggggatattttgcggggaatttgttaaccaaacaaggattgactctcgtgctccagttcagcatttgccggcaacttgagctgcagagaagtaaagagtcagctaaatacaggattatgaaacaaatagtgcactagaaccttctgctgtcattgacagaggacttgatattgtatttagtgctttaaacaaagtttgcagtgcagactatcagtgtgtgtcatccaaggcacacgattttcagctgttattgatagatgaatgtggtaatttatagatatgtgcagtcatttatgaatagcttattaaagttatatgttttggttaggtattaatgtgtatctatctatctagggatttggtcatctaaaaacactatgcataaataaataaagaggcttatattcttcttttagttataaatggtatattccattagtgatccccccagctgaaatatcccccccatatgcacagccatacctggaaatatagtttttctatcagtctgacttgtgtttttacttgaagaagaattcactgatagatggatagcgggatgggaagagtgtttatttctaagctttcaaacacttctgtaatctagggctcaagaaaaggcagaatagctgcctcacaagagcaaagaaagggtaaatggcaaactctcttaccctgcatcattcaaccttactggagcaatttcatttctttgaatatggaaaaagtgttctcaataatataaaaaggaagaagttggtagccaccctgaaacatccctctcgtacaattatgcctgtaatatttccatcttctattgatttttctagaaattataattcctaagggttaaaatatatagatagactgggtctgtggacattgcttccttttacttcgacatttaaaagacaatgaattgagatatcagacacataccgagtatgaaatctccatcaacctttcactgaaaatatatcctattttttaatataagaaatctcaattaggactcaaatgcatttgaaagttattgtccccaagaatttacatcatattgcatctgttttaatcctaatattataaatgtgtgtatagttacttgaggtctttattttctataaacataaatggcatgaagttcactacatctgataattctttttgaaggagtggatcatacaaaatagagattgcaaaatcatagaaagaaagtgaaattacttataatggtgttaatttaataatcttaacagccataaccatatttagaagtttccattattttgaggtaatagataaaactatagagttgtaccactctctggggtaacttcctagaacatatttgtcagagtttttttctttttacatttgcttcttaacctaaacttttctacctatcaacatctacatacttatctatctatgtaggataaaatcagcataatttttaaaaaatcacacatagaaattgttgaaaattctgcatccatttttaaatatttcacatgactgtgcagattgaaaatgaatttgcagaggtgtgttggctgaatgattataataatacatttttattatccattctctaaatacattttttgttatttgtatttacacatgcttttccctcttcccaagaagtcttctaccatcttttttacatctctacctctcaattagcagacagtagtacattatacttgtttgagtagaggaagctgtatttaacagacacacacagtaatatgaaaatataataatatcaattttatcacttcaagataaacagatattcttataatgaaaataatgttttttttctggaaacagaattattctgatctcatacatggtttacaatattagtgactgtaccaaaacttttatgtgggcacagttttttttctctttaactctccttttttatggcactggaatgtcatttgtaacaagaagttaataagaaggcaaattctaattctatgaaatcttgtcagaaaaaatgtgatggaagaagatgataatatttagagatccaaaataagtaatatatggtaattatgttacaaatgaaaacagatgatcttagcaaacttacaacatattttccataagagaagcttagtcatttgtagagaataatcaagttcagtaatgaatcaaagctgtattaaacatgccactgaaaaacacaagctgtaatctaaacagtataaattcaccaatactctactacttcctctatctctcttctaaaataaaacaatacagttgcatagcttctcttaaagataactattggttttagttagtcatttgcttagaaataaaaccctcttataatatatttccatacagtcaatttaacaacattgtaggtaacatcatatcttattcatacattgcaatccatggagcatttctcattgcaagaaagaaattccaagtagttctttgtatcttgtgtcttgcattagctagtcaaaagagttctactaaaagtaataaatggtgcatctttttgcttttgtttttactgtcacttcagatttgtaactgtagttaactgaaaacaaaattatacataattatatataacataacaaaattatacataacagatttagaaatcttgcatttttgaatgcatgcataacaaagtatttgatagttatgtgtctagtcaaagttggccttcttaagcttatatgaagttgtggtacaatacaacacctagaacaaatgatacaaatttttaaaatatttgtgccttatgttacaaaagttcttaattctatatttgattatagtgttagctaaatgttttatgcatttaattttcttttgataagagactgtatgatatacagttgacgtttgaataatgtaggtattagcagtgttgaccctctgcatagttgaaaatttaaaaataatttttgactcccccaaatttactactaatagcctaactcttgacccaaaaccttatgataacataaatagttaatgcatttttttgtgttatatgtgttatatactgcattcttatgataaaactagagaaaaaatgtgattaagaaaatgagagaatatatttactattgattaagtgaaattgaatagtcgtaaccatcctcatccttgtcatcatcatgttgagtagactgaggaagaggaagaaaaggatgggttgatcttgctgtctcaggggtggcagaggcagaaaagatgtaagagatgggaagggagacaggagatgcaggcactattagtgtaagtttacagaaatacattgtaatttctgttgactttttactattttctctaaacatgtttatttttaataagttgactatgtagtactgatctttctttcatcatttgcttttatttcagtgcccatatcatagaagtgtccatgtcacaaaagaagtcaaaagtagtctggaataattggaatctttccactagattgtctaatgtcaatttgttttctggcactgtgtcttctatgtcttcctcctcattgtcttggcattggtttggaggtactcatctccatcaagtcaccttcttttaattcctctgatgcagtacctattagctcttgaatttctttaagattgataccttgaaacctttcaccccttactttcttttgctatatctacagtatctttcacggtttccttaattgtctctgtcgtaaatcctgtgaagtcatgaacaacatctggacacagttttctccagcaggaatttcttgttgtgtgcttgatggccttcaaagctttttctataacaacaatggcatctttaatggcataagccttctaaactttgatcaagttctctctatggaagttctcttcgataatgttgaaaatcctttctatagagtacatgtgtaatggagacttaaaggtccttatgatcccctaatctaatggctgaaaaagagacatgtttgggagcaagtggaccacttggatgttttcagtgttaaacttttggggttctgggtgaccagagacattgttcgatatcaagagaactttttaaaaaggagtccttactgacaaggtacttcctgtcttcaggggcaaggcatcgatggaaccagtccataaaagggattctcattgcccaggtcctcttggtgcacaaccaaaagactggcagctggtgtttatgttttccattcaaggctatgtggttagcagctttatagataaaggcagacctgatcataaacccgactgcatttgcacacaacggtagagttagcttatcctttcctgccttaaatcccagtgttcccttcccttccttattaataaatgtcctttgtggcattttttcccccagagcagggcatttctgtctgtgttaaaaactggctcaggaagatatccttttctctcaataattttcttaagggtgtctggaaagttgtctgttgcttcttggtcaacaggagctgcttctcttcttatcctgaatttttttttcaagccaaacctctttccaaccttatcaaaccatcttttgctggcattatattgtttagctttagatccttcacctttcttttgcttcaaactgttatataataacttcgctttttctggaatcacattagagtctataggtatgcctttcttacaggaaatcttatatgtacacaaaagttatttggcaaaatatgtgcatgctgacgtagctgcaatgatggcttcaaacatttccttttcttgtttttataatcatccttacattgaattcatttatgttaaaataatgggcagccactgcttcagacctcaagctatggtacaacgttttcttgtaatgtcatgaattttctttgcttcttggaaggacttccagcattgctagtggcacttcatacaaatgccataatgttattcaagggtattgtatagagtgttttactaaacattatgaaaagtacacgagaaccacaagagtcacttttcactgtgacatgcaatttactagatagacaaaaggctcactggagattagtgtcaagtggatactggaaactcttgagctcactgtaatagcaataggaggtggctacaacattattacagtagtacaatatgtaatacagttaaattaatgcagttatgatttaatactgcatctttatattgtttatatttcttggtattacaaatggcaccacttacagtctgttcgtttgtgcaagttttgataaattttaactttttaataatttatttgtgtatatttcatcatagtaaatgataaaataggctagtatctacatatattttatgcactcatgacatagctcattttttcttaactctgtcaatttttctaggctatgcagttggtctgaattttttaaattgttgcaaatttacaaaaatgtttccaatatatttattgaaaaacatctgtgtataaatgtacctgtgtagtaccaacttcagttgtccaagggccaactgtactttttctcatacattttatacttcctcagcttttcagagatattccattatgttaaaaaatgctgttccttattttggtttcatctataatttatcatggagagacctagttagtttagaataaaaataacaataactaagcatgtaatataaactccttgagcaactcttcatctttcattatgtagatgaaaattgcccttgattcatttcctaatgtctgtgacctgtcagaggactgccaggatttcatttcctgcctgctgctcttctactctctttcatggtgacttttcttcctgcctgctttt

SEQ ID NO: 743 - DNA, 145277 bp, Homo sapiens
tagcacatacatagcatttaccccttcattttcaaatgaattttatccttttccccccattgtttttgaaaattgaatctttgtgaaaataagggttaatttaacataatcttactgtaggttcaggtgttgtcattatgaagaaacacacaatcacagaataaactagggaaaggaatcttggtctgttacctaacaatgggatttttggcatttgaactgtgtacttggtttgactggaaatattatcattccattcttggtttttaattctgtaaaagcaaaattcatgctccttttcttcttttacaaatgagagagaaaatgacttgctctttttattgctatacagttggtaagaagttgccactctttccatctacttcagtcagcttttctagtgaggcgtactcaggagcctagccctgttgcctattgcttgtccagctatagacagagcccgtggtattgaataataacatatcttaccttttgtccttgcccaactactcttaactcagatgtccagtagaatttgttttatgaaatatctttttataaccatattcttggtaaaatatatgcacatgttgaaggatacttgtactatatattattagggttggactgaaatgaaagatttcaaaggtatttgtttagggtattagatcctccagtgatgtatttctgatcattggattgggtggtgtcctaagagaaaggcattttaaatagtgtcatgtcctaggaaaatgttttgtttaaacagtttactaatgttattttctcttttttttccaagttgctcattttgcttctaatacttcttttgattgtaaattagggtgcctaattaaatttgaatgccagagaaacaacaaataatttttttataagttgcacaggtgtcttgtattgtgtgagcatcttgtatttatttgctaaatctggaagccgtacttgaacgatttctgaagtttatagccaagatgacattaagtccaacattcattctcttgaagagtttgtataaagtactatggtaaaatgagtattgcacataaagtcaggctagttctgccactaaatagcttcatgacctttacaaaggcacttgacctctctgggccttgggtttgtttttttttaatctgtaaaaattagaaggttggattaaatggtttctaaattctgtaattaaaaagatgctcagtttttcccttctcgatatgttagtaaacatgagacaaaaacaaaaggttggcaaaaatagtaaatagttatcatagacttttctatatgtatattactagtagatttatgctaactgtatgcatgaaatatctaggagtaccttctagaggatgtgggactttaacagggccttagtagatttcatgatactaggtcataaggaacaatataagtagtgacactaagtcacaagtgaagtcacatgtgggaattactgagtggatgaatttggcagaatcagttttgaaagagctatgaattcatgagtttgtattctaatactaactatatagagaatgaagtttaatgtttctcaaaaaattttttttttttttttgagacggagttttgctccgtcacccaggctggagggcagaggcatgatctcggctcattgcaactttggcctcctgggttcaagcaattctcgtgcctcagcctccctagtagctgggattacaggtgtgcaccgccatgcccacctaattttttgtgtatttttagtggagatggggtttcgccatgtgctggtcttgagctcccgacttcaggtgatcccccagtttggcctcccaaagtgctgggattataggtatgagacaccaccccagccaatgtttctcaaagtattaaagatacatgtttacttaatgtggcatttgctactttttaaaaagaaatatttgtgaggtattttgcaagggagtaggaattaggtgaaggaattacctttggagaaaagacatccacagagctctaattgcttttcactttaaggtgtatctcaatatagactacactttccccctgtgagagagtaggtaaatgcttatacctctttgcctgattacttcagcccttatgaatttctcccttgactaaaattccttaacagttacaaactataacccacttttttctccctcaaatgctgtttcttcaaatagtactatttgagagaagggctccgaagtaaaatacatttgggaaatgctgcctagtctatgcccctttaagaatgttgcaatccatttcagtacattaaagtcccagtcaaagagactgtttagccattttccaaacatttttgatctttgaactgttttataaatgacttttactagcatcccatagaattagtgttcttcagtgcacaatttagaaaacggtaatttttaacgtataattttgtacttaagttgtctatttaatatgtatataaatatataaaacatttaatgttcaaatatagcgcatcattctcagatacatcatttcatttgactcttagatttacctcgatttcttttataccattattttagttaactgtgaagacatagcctgtctaaattagataatttttgttttgaatcctacccttaagattctgttttataattataaatctatccatatgtagcctgcttcttcttcttcttttttttttttccttttggagacagggtctcactctattgcccaggctggaatgaagtagcgagatcatggctcactgcagccttgatctcctgggctcaagcaatcttcccacctcagcctcccaactacttgggactacaggcatgtgccaccatgcctatctaatttttttactttttgtagagtcagggtctcaccatgttgcccaggctgatctcaagctcctgagctcaagcagtccgcctgccttgacctccaaagtgctgggattacaggcctttggccaatgtgtagtcttctgtggtcaatgctaattcatttcttcttcttcttttttttaaaatgttttttacattaatagggatggggtttcgccatgttggccaggctggtctcaaactcttggcctccagcgatccacccgcctcggcctcccagagtgctgggattacaggcgtaagccaccacacgtggccatttcttttttttatccctaatatcaacataccttttctctttcataataatttacttgcccttacaggaaacacaacaacctagagtacgtccctgttctattattaactcatttattatagttaagagaacttggcattttaaacatttttttgaattcagagatggtaccatggttttaatctttacctaagagtatgataaccattagatttctctaacagttttataaattaataatcttgtgcatttggacacaagaccctataaagacttggattggtatagatctaatataacttttaaagaacttttattttattttgaaataattacacccttacaaaaagttgcaggaatagtaaaaagaattctcaaactctgttcagattcatcagtttttcaacagattcatcagtttttcaaactgaaaatttcctttatcattctgtctccctctctctctctctctcgctctacacacacacacacacacacacacacacacacacacgtaaattgttctaccacatttcaaagaaggttgcatatatcatgcccctttaccccttaatacttcaatatatatttcctaagaacaaggcaattcatttccataacgacagtacaggtaatttaatgtcagtataatactgtatcatttatgttcccattttatcattaatttatttcgctgtcatatccctagtcttctttaaactgaagcagttctttagcttttcttttctttgtggccttgacatttttaaagaatcgggctattttaatagaatacttctcaatttggctttttctaatatttcctcattattagatgaaggttgtgcttttcaggctagaatgctttgtaaattgtgtccttatcacaatgtaatatccagaggcacatgatatccatttacccctgctagataatgttcattttgatcagttggttaagatattctctggtttcttgactacagggttacattagtcctcttttatcctcagaggatatgttccaagacccccagtgcatacctgaaacctcagatagtactgtatctacactttgttttttcctatacagcaatgggcaggtagcatatacagcatggaatgctggacagaggtatgattcccttcccagactggatggaataggacagcatgtggtttcatcacactcctcagaacagcatgcaatttaaaacttatgagttgtttatttctggaatttttcattcattttcagacagtgactgtgaataactgcagatacaaaactatgggtaagggggggacagctatattatgtttccgtttgtaataggtaatttgagaggagttactctaccactgtaaatagcctatctttcttgaaagcttcccctcatcctagatttagcattcattgaatatacctacctgaattaattttactatgatagtcacaaatttataattttctaaccccttcatttattccatatttattagttagcattctgttataagcaagtttttcttcttccacccatctacctgtctatataatatttctctactatctgaatgagcttatggatatgtaatgggttataatcagtttttgtccttatgtatttacttttaaaattattacagaattattttagatttacaggaaagtttcaaagatagtacaacttcacccagttttctctaatgttaacatcttacgtaattggagcccatttgtgaacagtaagaaagtaacattggtacattattattgagtacactacagactttatttagattctactggttttccactgatgtcctttttaaatatttgtcaggtgttttgtagtgttcttcaatttgggtttgtctgatatttctcatggttagactggagttacaggttttttgagaagactaccagagaggtcatatatcatatcatatattgtatcacggggtacatgataagaacatgatttaacactagtgatattaaccatgatcccttggttaaggtagtgtttgtcaggtttctccattataaatttactggttttcccttcttatttttggaagtgggtcaccacctccatcctgcactccaaaggagggaaattaagctcactccctgaaagggagaatacttgcatatactattggggattcttctgtaaggaagatttgtgtcttcttccccatttattttttatattcaatcatttatttatatcagtatggactcatgtatacttaatattttatgctttgagttacaatctaatactgcgttgtttattttgttgctcaaaattttacagcatcagccactgagagctttttggggttggctttggtatctcttggatatgccccaatccttttgttttttgagcacttccttactttctggcactacagaatgctccaggctcatcttgttctttccttgacctaaaattagctatttctttattttgatgctcaaatggtcttagatttggccaacgggagtcccttcagactgactcctgtgcttttgatatgcccccattcatccatctcttttttttttttttgcccctccttatttaatttctagctcaacaagatgtttcagattcattttgtagtttccttgccataatcctaaaatcagccatttcttcagtaagtcttaattcttttttatggaaaacagtatttagcaactgtaaaatctgggcactaagtggctcattgctacaggaatatcattacttctaggccctatttcagtagacagagttcagaaataaaattttaaaaatacacaaacatgagttcatatataaacctccaattccaatcaaactccacagagttcttcctggcttcccctattccatgcaggacttccccttccacagtgagaactcaggcttccaacagcattaatatattttacttatttgctcagtcctacaatacatatacagtagtttcagaattgctatactcataccaatatgaaaaataaacctactggccgggcatggtggctcaagcctataatccccgcactttgggaggccgaggcgggtggatcacttgaggtcagaagtttgagaccagcctggccaacatggtgaaaccccgtctctaccaaaaatacaaaaattagccaggtgtgttggcatgcgcccgtaatcccagctacttgggaggctgaggcaggagaattgcttgagcccgggaggcggaggttgcagtgagccgagatcgtgccagtgtactccagcctaggtgacagagtgagactctgtctcaaataaataaataaataaataaatttaaaaacctactaagaagaatttaagatttgtttgcaatttttttttagactaatagtatatagtcaaagtacagtgttcttaagttgtttccctctgcccccgccttcactgtggttatattattcctttgaaatacatttgtgttaattggtttctgtattctttccattttagcgatcttttttgacaccatccttgttaacttttgttttttgaatatgtagaacattgacataattccaaaaatcagaactatataaatggtatactcagagaagtatcaatccctcccctatctcttctaccccttacttattccacatgtactccctcccagcccttctaaatggaccaagcacgtatgtgcatgtttgtttctcctcctttctagcacaaaacataacatatttattcttttgcagtttgctcttttcagtaactgtatatcctggaaattactccatacggtccctagagatcattctttctttctttctttcttcctttttttttttttttgagacagagtcttgctctgccacccaggctggagtgcaatggtgcgatctcggctcactgcaacctctgcctcccaggttcaagcgattcttctgcctcagcctcccaagtaactggtactacaggcgagcgccaccacacctggctaatctttgcattttttagtagacacggggtttcgccatgttggccaggctggtctcgacctcctgacctcgtgatctacccgccttggcctcccaaagtgctgggattacaggtgtgagctactgtgcccggccaatcattatttcttaaagcagcatagtgctgccttgtgaatatgtgccatagtttcttcaactatgtacctatgtgtaggcatttaagtagtttccagtatcttgctattgcaaattgtgctgcacagaatactgttatatgtggccttttgtattttggatatgtattttcaaggtaaatttcctagaagttggactgctagattgaagggtaaatgcatactgtatgtagttttgttaaatgttgacgaaatcccctccaaaagagcttgtaccattttatattccatcagcgattcggcataacttttggatctgcaacagctaggagattaagtctaatggctgggcgtggtggctcacacttgtaatcccagcactttgggaggcctaggtgggaggttcacttgaggtcaggagctcaagaccagcctggccaacatggtgaaaccccgtctctaccaaaaaatacaaaaattagccaagcatggtggtgcatgcctgttgtcccagctactagggaggctgaggtgggagaattgcttgaacctgggaggcagaggttgcagtgagctgagatagctccgctgccctctaccctgggtgacagagggagactgtctcaaaaaaaaaaaaaaagattaaatctaacaagttaacaagtcatgcagtaacaagtcacagccatgattaactccctgaaggaccccaactctttgaggtctccaataaagaccacaccaaaccaatatcctcctggaacggcctgagagcacctagaagtagttcaggaattatcctaccttgccagaatgttgtagatacccagaggaagagtattatttggagagtattaatggcaagtcctaaaacaactagccaaaattcagggtgagccaaacatgtattataaagacaattgaaaggaatatttgaaattagaactattccagaaaatctggactgcctaggttggcccctttgtcggtagaaacttaataaaagttttttcacctgttatccatgggttttaaaaaaccctttgtttcttgcctggtggtcctgataaaaagaaaaaaaaaatcaaaaaacctttgtcctcgtggttatttacatcttaaaacaggatttgatgttgcagtttgcctaattcttccctgaaaaccaaaaggatagttgctgatcacttcagaaatggcgttattcttcagcaaggaacttatgctatgtatttgagctttttgaagcatacgtatataagtatgcatagtatatttatttgttcttttagtacatttactctttagttaaatttccttcacacagccaatctgtgggtttcctttttccgccaagaagattgctgttaccagtttagatcaatggagggccaagagaaaggccagagcagtctgaattagtaacaaaatccaattattgcatattttacaagaaatatggaataactttaaccgttaagagacttctttgtacacctgctgttaggaatagtccacaataatttcttgttatcaccattttctatttaatgggttcttctagtctagaaaacaaaaaaatccttgtttttaaaatttctgttacaaattggaaaccctgacacgttttcagtggcttcctgctctttggtcctgctcttgtactttttgtggctattataactgcagctgccaaaaacgttcagttaaatgggagattaaaatacattccacaaaattattgaggctattcttcctggtgctataagaaaaatttattggaaatgttgtttatatgtaggaagctggtatgtttctgattcttcaggtgacatttttctaattcttaaagttcttgaaaataccttatttatattatttttctgtttatacggaaaaactttctacataaaaattttggatatgaattttaattttggatatgaattttaactcagattctatttactttggttcacttcaacaaacatttattcagagccagaagctgttttagcagatacaaagataaacaaacacaaatgattaattcatgttatctgaaattatgggtttattatattcatttttttaaagaagaaaattagattctttgggacagccctagatagtaaatttaataacatttatattctctttgtgtgagtagttacttgctttagacacttacaaaaatcttaactggtaacaattgccaactaggtttttttccattaattaaaagaaactttttatatagtgaaggaaatgatcatcttgatatattctactatattattatttgctttatacttgtttttattgaaattatctttctactttgctttttggggaatattgccttgtcagacacagtctactaatacctaagaattatgattgcaaacctagctgtagaatatttttacttcccttttgtgatatagatttattttttaatatgacatatgattccaaaactcagaaataaaattttttgctgctaaagtatacagcatattctaggtatcctacaatgaatatctgtatggggagaggagagagacaggagaagatagtggtctttagcattaggaacttatgtatttttaactaaaatatttattaacatatgaaatgttatgagaactataaacttggaactccactatcagaagctttactataatttgttaattgaagataattctgatgaattttccctttaccttttgctttccccttttttcccgctgcttcctctgaagtctccttccaaatggttttggaaactggttccagtaagtttgctcagctacttcagtttgctctccagaattgtaattgtagaatggtattgtttatgtcttgctgttaaagtcatttcatgtaattctgttagtcattgaatagagattggattttaaggtcatgtaaaatggaaagataaaagatacagccaaggtttagatcagaagttctaaaaataatttaaagggtaaacatcctgttgctaatcttgtcagtattcacagactatcagtaagtaggttaaaaaaaaaaaacttatgggccaggtgcggtggctcacacctgtaatcccagcactttgggaggccaaggtgggcagatcatgaggtcaggaggtcgagaccagcctgaccaacatggaaaaaccccatctctactaaaaatacaaaattagctgggcgtggtggcgcatgcctgtaatcccagctactcgggaggctgaggcaggagaatcgcttgaaccagggaggcagaggttgcagtgagccgagatcgcgccattgcactccagcctgggcaacaagagtgaaaccgtctcaaaaacaaaaacaaaaacaaaaatcttactatgtagcttctcattaatttaaataattttagtaaatattaatttgaattgcatgaataaattgcctgcatttaaaaatcatctttgtggctgagcatggtggctcacgcttataatcctagtactttgagaggccaaggtgggaggactgcttgagcccaggagttcaagaccatcttggacaacatattgaacccccatctctatttttaaaaaattatctttttgacagacctagttccttttcagcttgaattatagatgacacttcactttttgtgtgattaagaaagcagaaggttttctgtgacctcaccagtagcggaccaaaaccatattaaattctgatttgacttaaagattgatctttcagatttaaatatggggatgggtgtgttaaaccacttaagaactattttacatcctcgataataaaactctaatttagaaatataccataatggccgggtgcggtggctcacgcgcataatcccacactttgagaggccaaggcaggtggatcctttgatcccaggagtttgagaccagcctgggcaacttggcaaaacctcatctctacaaaaaatagaaaaatgaggcaggcataatggtacacatttgtggtttcacctactcaaaaggctgaggtgggagaatcacctgagaccaggaggtcgaggctgcagtgagccatgattgtgccactgcactccagcctgggtaacagagtgagacgctatctccaaaaaaaataataataataaaataaaaataaaacaaacaacaaaaaaaaggagaagaaaataaatataccataatgttgaaatataaaaatatagggggttctttctaaatgccaaacttcttagtttgcagaaagaaagggcatgtttccatgcaataagtttataaagcaaatagcatgttcaagtacaaaagactctttcatgaactgcggatgaaccttctgagtgctggacataatctcaagatttaaagttggtttacttaatatatcttctagaatacaatctttaggaaaatgttttggcatcccattcataattctctgtctagtctaaaccatagatacttattgctaatgtcatataaagctgtgtgtgtgtgtgtgtgtgtgcacgtgcacatacatgtgcctgtttgcacataccttgtacaaaagtgctactttgcaggagggagtagaacaaatcacataattcaattctttgttgcatgaccctgggtgcttggcttagtccaattcaggtcataggctgaaaacaaactactagtcccagcccaattttgaggatgtccaagaggcagactgtttttatcccagataaccaaagaaaagcatgtaaggatctggaacagatactaattgtgagaacggtagcttaagcctagaagataccgctgtactggttgatttcttttttctttcttccttcctcttccctccccatggttgattttaagctgtttcttagctgcaaagtgaggaattttctaagaattatgttaaaatcagaatcaattaaagaatccatatagtacctgcaagtaatttttttctgaatatagttaccccctgaattagggatgtactcttaaatacggagtctattatgcactaattaacaagaaccttcagaaatctttaagaggaaaacatgttccatgaattttgtccttgggtagccagtgagagaaatccaggaataagtatctccttcttcattaatgctgatgcttttctgagagatagcattgaaaagaaatctaacttcactaccaaatgttgtgttctctttcagtaaatttttatttttctatttttattctcacaaaagtgttttatcttataattatattttaattctaaactatagagatgaccaatttagatggaattagaagaaaaaatagtttgataaccttaaaaaaactaccagtaatttatgttatatattttgctagcaaaatactttcgtgtgtacattcactaaatcttcagcattattttacttggctttagaagagttaacagctaataatagctaacctttattgattgcttgctgtgtgcccagcaggatgcatagcactttgtgtccatcatcttacttaatcttccagtggttctatgaagtgggtactattattacgccagtttacagatgggaaaatgagaaatgagagtttaagtaacttgtccaagatcacaaaactagtaagtggcagaaccaggatctgaaccaggatctgaatttgttctcttaactattacagcatgtctcattttttagagatctatttttaaaaattctatctagccacaccaaacaatctttaggaaacaaaggtttcttctctttttctgagggggagcaagaacccgtatacttgctcaattattaatgaaatctaagttggaagggtttttttttttttcactttcaaagttgttaactatttgtgtttcctcaacattcagataataacccagaatgtcttggtgatactattccagttcctcaaatttcttttaagaatagtatattcttttaccttccccctcattttgataactctttctgcttgaatagtattcttgctcttcccgtataagaattttcagtttaaattaagtctgaattaaagtagatgaattttattatcttcaaaagagcagaactgattatttggatacaaagtgttcaaaatctgttttgtgatgcttttatacttaaatatttaagccaaatgtcagttagtgtaaattagcagtatgttatattaagtattgagcttcaaaactatagctattgttgccgtgtatttaactttggtaatacctagcgttatttagaaaaaaagaaatattggtgagtggtctcatttctcatgatttattttattactggtacattagaatttacagtactgatttttttcctatgcgttatttggtacttatttattttcatgtattttttttatatcgtaggctcgttatcggaaagagcaaacattgcttaagcaactgccttgcattccattggtagaaaatttgttgaaggatgggacagatggctgtgcattagctgcccttattcatttttactgtcctgatgttgtcagattagagggtaagtgttccattgtaatacttctgaactgtagacagatagtaaccaatatttaagacagtattattttgcactccagcctaggtgactgagtgggaccctgtctcaaaaaaaagacaatattatttaataagtactgaagacttttttttaaaaataaagaacatttatatataattctgagggaggtagttcaaaaaaaaatagtgctcggtttctaagtcttaatgtataatgactactatatttataaatgtatgtttgttaaccagaattgtgtatttgtactaattacaagatggatatgaaatatttattatcaaattaatccaaagtcaccaccttgctcttttcttatttgaagatatttgtttgaaagaaactatgtctttggctgatagcctgtataatctgcagctgattcaagaattttgccaagaatacttgaaccagtgttgccatttcactctggaagatatgctctatgctgcttcatccataaaggtaaattaaattattctttttttccctttgctttgttaaaatatgtttttttaaaaaacaaacaaaaacaccgggaacagtggctcatgcctgtaatcccagtactttgggaggacaaggtgggaggattgcttaagcctgggaggttgaggcttcagtgagcgatgatcgtgccactgcactccagcctgggcaacagagcaagaccctgtctcacaaaataaataaataaaattttaaaaataaaaaataaaccatagaacaagatatataaatgacctagcaactttaagcttatagattaactatattagtcaaaagaacttttgaagaaagtttttaatttttttctccttattttgttttttaatatactataagctacaagtttcttttatagtgcaaagccaaacttaaagtcatgtacaaaattggccagttgtagtgactcgtgcctgtaatcccagcactttgggaggaggaggtgggcagatagcttgagctcaggagttcaagaccagactgggcaacatggtgaaaccccatccctacaataaatacaaaaattagctgggagtggtggcatgtgcctgtgttcccagctactcgaaggctgaggtaggaggattgcttgagtctggaaggcagaggttgcggtgagctgagatcgcgccactgcaccctagcctgggcagcagagccaggccctgtctcaaaaaaagaaaaaaaaaagtcatgtacaaaattgatctattgtcttaatgtttgcaaaatagagaataagccattaaatgtttcttacaaatagcaatgcttacaaatagtaagattctttataaataatgaagctttctttttcttaaagaatttttaatttttgaattaaaaaattaattgaaaagtaacattatgtactatttaactaccattatgcataaatatatgatatgtatagttaaatgatatggtatccttgcgtatttttatgtgtacaatgagtcattgagcattaaattgaaatttagtttgtttattctcactagattatatataattgttctgtagttaccagactgtttgaaatttgtcacgtttattgtcctttgactgtaggctaatgtatgctgtcagattgtgttaaaataataaaatttcacatgggtagtattattttcttaattttaagttgaatatattttatttacattgatgttaaatgttaaaaataataatcatggctgagcatggtggctcacacctgtaatctcagcactttgggaggctgaggtgggcagatcactgaggcgaggagttcgagaccagcctggccaacatggtgaaacctcacgtttactaaaaatacaaacactagccaggcgtagtggcacgcacctataatcccagctacttgggaggctgaggcaggagaatcacttgaacctgggaggcagaggttgcagtgagctgagatggcaccactgcattccagcctgggtgacagaataagactatgtctcaaaaaaaaaaaatcattattatcatcatcacgaatagatttttgaaaatcattccattccattcccaagtttgaaaattaagttgtgttatgaatactgttatttttaatacttcaagaattatgtcttatcctccagatgttattttagtaatgttagtgttgtactttatgtgagtcaataatataaagtcaattcagaaatcagaaatgttttctagttgagtcatattaatttatgaaatactgaactacaatataaaaacttcaggcctggtgcggtggctcatgcctataatcccagcactttgggaggacaaggcaggaggatcgcttcagtccaggagtttgagaccggcctgggcaacatagtgagacctttgtctttacagaaaataaagttagccaggcgtgatggcacacatgtgtagtaccagctactcaggaggttgatattggaggattgcttgaacctaggaggctgagactgcagtgagccctgattgcatgactgcactccaaacttagtgacaaaccaagaccctgtcaccaaaaacaaaacaaaaaccataggggctttctcttttaatttttaaaggttaaaaaagagtgtttaaaatagtaattatttgaagttcaagatttgctgttgttaaaaacatggtgggaatcatatacatgctatataaacacaggcaacccccatgtatgcagttttagttctggtaaaccatttggaagcagactggggaaacgaactgggtacacctttgcttttgaagaattttaggatttgtttgcagctactctaggttaccaagtgtcacatgtgcatcattagaacaaagccctaatttaagacactgaagaactacagaatgcaagtgtgtaaaagttattaagatgaaaagaaaggagcgttaaacaagtttgtcagcaaaatgtaaaatggcaaaatttggagattattataacttttagaacattgcaggacccacactaatgtttgaaaaatattttagcgagagactattatatgctagacactgtactgagcctggggatttggtcatttattcattcatcggcagatatttactgagtatctccatgtgccagacactattcttagctttggaggtaaagcagagaacgaaatggcagggtaaactataaagccagtggtaaagacatttctaaaataagccactgctcctgctgacccaaagttgtacccagtctcttgtgtctgacacatcaaaaaaaatttttttctaattgatgttgaaggtttacacccttgccattcatatcagaatgaaaggtaatatcatttccatatatatcttgtaatgctttttctggtattttcaggtaataacagaaatattaatttctgttagtaccagaaaaggcatcaacatgatatctacattgtcagctaaaaatttaaatgctacttctgtaatctcaaaggaaaaaaactgtctcactaaatacatggagatataagattgcatttgtttaagttggtataccttggacttccaatacataatatacagtcctgatgtttatatcaactttgtctgggtacgacccatataaagatattttcttaaattaggtatatttaaactatgattttctacagaaagggctttggtcactttctatgttctttacttattactaccacagctttgacttcatttgaatctttttttttttaattcaatcttattttaaacttttagcttaagctcaagggtacatatgcaggtttgttacataggtaaacttgtgtcatgggagtttgtggtacagatttttatttcgtcacccaggtattaaccttaatacccatcagttatttctcctgatcctctccctcctttcaccttccactcgtggatagtttgcagtttctgttgttctctttctgtccctgtgttttcgtcacataagtgagagcatgtggtgtgtggttttgtttctgcattagtttgctaaggataatgacctccagctccatctgtgttcctacaaaggacatgatcttgttcttttttatggctgcatagtattccatagtgtatatgtaccccattttctttatccagtctagcgtcaatgggcatttaggatgattccatgtcttggctattgttaatagtgctgcagtgaacatacacatgcatgtgtctttttggtggaatgatttatgttcctttgggatatacccagtaatgggattgctgggttcagtagtatttctgtttttaggtctttgaggaattaccacactgttttccacattggttgaactagtttacactcctaccaacagtgtgtaaatgttcctttttctctgcaactttgtcaacacctattattttttgactttttagtaagagccattctaaccggtgtgagatggtatctcattgtggttttgatttgcatttctctaatgatcagtgatattgggctttttttcatatgcttgttggccgcgtgtatgtctatgtcttttgaaaagtgtctgttcatgtcctttgcccacttcttaatgagattatttttatcttgtaaatatgtttaagtcccttatagatgctggatatgagaccttggtcagatgcatagtccgaaaaattttctcccattctataagctctctgttcacactgttgatagtttcttttgctgtgcagaagctttgtagtttaattagatcctatttgtcaatttttgcttttgttgcaacttcttttggcacctttgtcatgaaatctttgcccattcctatgtccagaatggtactgcctagattttcttccagggtttttatagttttgggtttatatttaattctttaatccatcttgagttaatttttttatatagtgtaaggaaagtgtctgttttccatcttctgagtatggctagaccgttatcccagcaccatttgttgaatagggagtccttccccattgtttgctttggtcagctttttcaaagatcagatggttgtagatatgtggccttatttctgggctctctgttctgttccatttttgtaccagtaccatgctgttttggttactgtagccctgtaatatagtttgcagtcaggtaacatgatgcctcctgctttgttctttttgcttaagattgccttgggtattcaggttcttttttggttcaatatgatttttaaaatagttttttttagttctatgaagaatatcattggtagtttaataagaatagcattgaatctatacattgatttgggcagtatggctattttaacaatattgattcttcctgtccatgagcatggaatgtttttccatttgtttgtatcatctctgatttctttgagcagtgtattgtagttctccttgtagagatctttcacttccctggttagctgtattcctaggtattttattctttttgtgccagttgtgaatgggattgcattcctgatttggctcttggcttaactgttgttggtgtataggaatgttagtgatttttgtacattaattttgtatcctgagactttgctgaagttgtttatcagcttaaggagcttttgggacaagagtatgtagccttatgaccatcttaactaaaagaaggaaagaagaagcttttaaatgaattaatctggcatcattcctgaaatatggtgacagatttattgctgtttaatcgtcatgaactcagaaagacataatcttcataagttttaattactgggaaaattatttcttactctactgacatcttgtggccaaatagtacaattaatgttattaggatggctatcttaccaaagtccttaaaatattaacttattttctgttcaacagataattattgagcacttaagcagtattttttcaaaatataatcagctttcagttaactaggctagtaaaatggaacctagcaccagtacttaaaaaccaattttatactttggctttagaaagtataccataaagataagtataaagaagaaatataaatcacaataatcttactaatcagaaatattgtgtcaatgttttgatgttttactgactgttttttttagtacgtagattcattcatttgtacattcatttaataaatatttattgagcacctatcatgtgccagacactgttttaaacactgaagatataatgatgagcataaactttgtctttttagactttatcatctggagggtaagatgaggaaacttggagaatgtagtaatagataaatctgggaagagaaaaagggactgtaccaagtagcctcttgtaagccatagtaagattccctttacctcaagagcaatggaaagagagttgcattttgaaaagtttgttttcttagcaagccaaagaaaaagctattgtgttccaaacaaggcaaaaatgtttgaatcagagcagttatgatggagagaagttggtgaattccagaaatatttaggatgcaaaatctgcatgctttggtgatgaattggacatgggagaaagaaggtgtcaaggatgactcctaggtttctggtttgcacactgggatagtggtgccattcagtgagataaggactgcagtaagatcacatttgtagggaaggtcactatttcaattttggacataggcctttgagatatccaaaagaaaatgctcggtaggccactgcatatataagtgcagtcagtacatttgagaatcatttagtagctgatggacgtaggcatggcagtgtttcaaagaggggcgagatcaggaatatcaaatgcagctgagaggtcaagtaagatgggaaatctgtttgatttagcaacatatgtacatcattggtgacttgagcagttgctgttaggggaatgatgtgactcagtgccaagactgaagtagattagagagtaaaagtgatgaaatggaaaatgtcagtagaggcctgctcctaaaagaagtttgtgaagaggtaaaaagatggtgggaatgaggagaaactagagaatagttattgagtaaaggttttgtttcatttattttgatgggagggatttgagcatgtttaaaagccaaataggaaggattctgttgacaggggaaggatacatatgtaggagagaaaagtaggattaagaatataatggcattcacagcaatttggatggaattggagaccattattctaagtgaagtaactcaggaatggaaaaccaaacatcatatgttctcactcataagtgggagctaagccataaggatgcaaaggcataagaatgatacagtggactttggggactcagggaaaaaagcaggagggaggtgagggataaaagaccacacattgggtacagtgtacactgcttgggtgatgggtgcaccagaatctcagaaattacttaaagaacttattcatgtaaccaaacaccacctgttcccctaaacacctattaaaataagaaataaattttttaaaactgtaaagtttctgagaagtcaagcagggatgagagccactgcatagcctttacggattataagcattcttattactttttttagtcacaaattttaatggctgcttcaattagtatgtatctgtatatcaacattctaaaattctgagaatttacagtaaaagcaaacatgaaggtaaagtagaaacctaccaaatgctcttcaccactgtgcattatcttctgtaatactccagactcttacactcagccacctacaagacaggtccacttaaatgtccagtgaacatctcaaacaatgactctagattcctttcattacctgtttctcccagtcctttctatctcactattagttgctcgagacaaaaacctaagagtcatcactcttgattcttctcttttcatcactttctttttatttttttttagagacagggtctcactctgtcacccaggctggagtgcagtggcacaatcagccaaatcctgggctcaagctgtattcctgccctagcctcccaagcagctaggatgacaggcacgtgccaccatgcatagctaatttttaaaatttttatagaggcaagctatgttgcccaggctggtctcaacctccaggcctcaagcagtccttcctcctcagcctcctcaagcactgggattacaggcatgagccactgcgcccagcctcttttcttcactttctacatacacgatagccttccagaactatcagatgagagatgatatttgaaagtcaccaacttaaatatgagaaaaccaagagaacgcatgagttctagtggagagcatatagagtttaaggattattcataattagcaagtaggaagaaggcaagacattagaaaataaccatatccaggataatcttaaaaactttaatatgaaataagaccttattaaacattaataaatttgatagtaactattttattaaatgccaaacacccaaaatttagaaaacatattattttaaatagttatgaaaacagattttgtagtttttaaaaatttaccgaatgcctaaaattgaaataattcttcatgcttacagcttttattttatatgcattttaaaatataaacttgtagtagaaatgtgcttttgaggacccttaatcctttctcttaattttaagccatttaaaaaattatttacattttaaaatagtaataataaaaggtaacattgttgacttattgataacttttcaaagttaggtagatacattcattgtataaataatgttttgtacatttcaaaattattaaaaattagctataaaaatttagttttggtgttatttagcacctgtattactggtgagtttaacattactgagcacatacatataactttttttgtttaagacggagtcttgccctgtcacccaggctggagtgcaatggcatgatcttggctcactgcaacctctgtgtcttgggttcaagctattctcctacctcagcctctcaagtagctaggattacaggcacgcgccaccacacccggctagttttttgtatctttagtagagacggggtttcaccttgttggccaggctggtctcaaactcctgacctcgtgatctgcccaccttggcctcccaaagtgctggggttacaggcgtgagtcaccacgcccggccaaataaagtatttttttaacactacatccagttacgttttggagaaatttctagggatctgagtagagcttagttatgttttgaaagtgataacccctctttagagtgtcagatgattgaataactttttaagttgcttatatttactttggaatgaaagtgccttatatattatctcagtgttctacacagttagaggtattcatgcctgctagatcaattggaccaccattttagaactatagagcaaatgatcagcaagaggttttgaatagttataatttttacccacaagagttaatattccatcccatgtttaatagcctactatagtgaatatactccagtgatgaatgaatgagatttaaacctatattttaaaacaataaaattctgtttatcatgaagttttacctaatgtaggctttctcttaaatttcctatatagagtaattatttggtgttcatggcggaactgttctggtggtttgaagtggtgaagccgtcttttgtacagcctcgtgttgttcgtccacaaggaggtaatcaatctttttaattttaaatgttcctatgaacagaaaaaaatggaatgttgatataaccttacctggttacatttttagaaatcagcctattattttttttttagatttcagctattacacttgatagattctcctaacctcttaaaatggttagaggagaagaaaaagaaaatggagggaatggctttgaatttgaagtcttatgatgtggaacttttagctttaactgtccatttcttttctttgcatcttttatcgttatcccagcttttattcccttttagattcttagtttttaacattgtgttacccagaatccccacaaattattgtttggccttaacccgcaactcgaatttgccattaaactataaaaaggtttgtatggatttttaaacctagtggattttatgactattatatcatgaactattgattgtacataataagaataaaattagtaagaaataagggggttactgtaaagacccctagatataaggaacaaaaaatcttcctaaattttctgtaaagcaaaatttcacatagcaaaaccaattttctcttggctcccattataaaactagaggtttatttctaggctgggtgcggtggctcacgcctgtaatcctagcactttgagaggcctaggcgggtggattacctgaggtcaggagtttgaaaccaggctgggcaacatggtgaaaccctgtctctactaaaaatacaaaaattagccgggcatgttggtgcatgcctgtaattccagctactcgggaggctgagacagtagagttacttgaacccaggaggcagaggttgcagtgagcgagattgcatcactgcactccagcctgggtgacagagatgagacaccatctcaaaaaaaaaagaaaaaaaaaaaaaactagaggtttatttctatagggggaaaaatgatcttaaattataagcttagcccactaaagaactttcttccagcataacttatggaaacatttctgtctgctaccaatagctgccctacccaacgcaacacatgatcattgtgcatcccaactacttagcagctttccttggctccaaagtttgttatttttgtaactgctaccgttacctgcacctccccgctaaacccccaaaaaataaaagaagagaaagtgatcaggaaggaggaaaaacatatgtagccaaaggggaggcatagtctagtgagtacaatgaggttacttcaggcagcccaccgcatctcaggcaaaaatctgtgaaataagcaataattagagtattgctaagcttcttaaggcagattctgaatatcgagtcactatataacattatataacttctttacatgcctataaaaaaattgagatgctcccctaagtccattgaatgaagtcagatattcttagtaattttcataaccaatatttgtataatttttaaaaattattaacagggttttcactacattgctttctgtgatttcacctgtgaagctcactattcaaaataccaacagctgttgcatcagatctcaaagtcaaaaagtaaattgagtcttcctccagagttacttacaaaaataaaagtataccagcaggtttaattattttctaaagaaattctgtttttctctaattgaccaaaataccagctgtttcataaagaagcagagctgaccatatgtatctgaagttctatgaaagctttcacaaaactaaacgctcaaacttatttttgttttttttttgtttgtttgtttttgttttgttttgttttgttttgtttttgagatggagtctcgctctgttgcccaggctggagtgcagtggcacaatctcggctcactgcaggctccatctcccaggttcacgccattctcctgcctcagcctcctgagtagctgggacaacaggcgcctgccaccacgcccggctaattttttgtatttttagtagaggtggggtttcaccatgttagccaggatggtctcaatctcctgacctcgtgatccaccggcctcagcctcccagagtactgggattacaggcgtgaaccaccacacccagccacttatttttgttttaaatacatgtatttattttatgttaggctttttccccctaattatccttaatcagatgaattttttaatttaagaaatttttggctgggcgtggtggcttacgcctgtaatcccagcactttgggaggttgaggcgggcagatcacaaggtcaagagttcgagaccagcctggccaatatggtgaaaccctgtctctactaaaaattcaaaaattagctgagcgtggtggcgggtgcctgtagtcccagctgcttgggaggctgaggcaggagaattgcttgaacccaagaggtggaggttgcagtgagctgagatcgcgccattgcactccagcctgggtgacagagcgagactccgtctaaaaaaaaagaaagaaaattttttttaattttgaaattaagtctgaatacttcaaaaagatcttaaagaaacttgaccctttgaaaattatttaagaagaaaactttatgctatgatttctcaatacgtagaaagggaaatagaagttaaattttgttataaatttgcttatggtccagaatttttcatagaaatatgctaatttgagggtgtttttaaaaatcttttattccagctgaacctgtaaaagatatgccttcaattcctgtcttgaatgctgccaaaagaaatgtcttagatagtagttctgacttcccttcaaggtaaactccacaatgactttattttcaccatttctattctatttactaattaaattacataatattatattacattaaataaggtttttaagaatttcagttggattttgaactgttataattagcttaccctattaaagcctgttttaacttaaatataaattgaaatatacactgaaatgaatgtttatgtaccacactgaaaagatgggacaatatattctaagttcccaataaccaacctaaaaccaaacttttgatgcataacttgttcataattgagaactgtctaataggtaactcttaggccttggagggaaattttgaaattctattaggacttttacatattttattattttaaaaatctttgaaggtttttcctgctttttttttttcttgttaggatagctattgagagatcacagtgttacccacacaacgggtgggtttggtctcttggcagatgacagtccaaagccacaaccaaggaggatttaacaagacgaggattttattacttgcagcaagtaaggaggacaccgggaataattccccaaagcagtgcctcctcaagcagaggtgaaaatagggcttttagtaggctggttaactgtatcattgtgtgtagaggtggagtaaaggcagtaaaggcacagtcatcagtcatgcttctgcatactggcatgtatagaaaatgcggaataagctcctccttggatgggatttttagtgtggtaatggtaatacatttccgtctcaggcatctctacatccacccagcttgtgtagtttttgttttgtaatgtggggttgggctgcttcctggaaatttctcaaacaataaaaatttcaaggtgcaacagttacaagcaggtaccttttcacagtgtgtacctgaaaacccaaggaccctgggttacaacaatagaatatttattacaatattaaatctttaatgttttagtacatagtattaggaactaaactgaaagcaaagtaaaaatgtcctatcatattaatacctagataatcctgacttctcacccaggtatatgatagggacattagtttgtttaaaaatgtatttcagcagctcctataagcagctttttatttgaatctattagaacctacaatttatattgactttggactccctaatctatctgattttttacgttaaaactaatgtcttttgtgggtttttggaaattcagacacattaaaaatacatttcaaaaattatgagtaaaacattcaaagtaatttctgtatgaattcttggcttaacacaaaaatatgaaatttagcaggcatggtgggtcaatagtgacatttccttccttgaagatttagaaaacactcagtgttctaggtcatcactcttgctctattaaatctttaaattccactttcaaagtggaggaaagtaaagctttccactcaaagattagattattccataattattctaggaacctaaatggacagtctcccacatttctgaaaaatgttttaattcatgtcctctggaaaactcatctcttttctgtctctcagacatctcagcagctcatttttcctatttttcccagcagaaactctttttataatgcagatggatgtctacattcttttccttgaaaagttattgtgtagccattattctaggctattctgagttcctagtcatcctctcatttctataagtctccatatggtccattgtagttctccaacactgtggaacttttgagaaagaattgaagtatttttacccttcctgggaataatgtagccacatctcaaatgttagtgaacctaaataatgattttatgagaaagaaaaaaacaaaggacgaagacagacaaagcaaaagatgttttcagcagctactccacacacttggctaccagctgttggagatatacaaacaggtccgtgagcagagaggctgtcaaggtattttactagggtttattatacctatagtttttagagattagatttgaccaaagtatttcaaattggtgagtttcattttacttttttatatatcagtttttatgtttataaaaatgaaaataattcatatctcacaaagacattgagatgtatatgaaagtacttcaagttgtttggctaaaagacataaaatatatatagatacatactgtaatcacagccattctttggtttaaacaatatgtttccatatttttaaaatttaggttgtagaatgagaggtggtagtgttgtttctaacttaagacattctacctaaatttatattaaacagctaaaatataacattttaaatttattttccattgcagtggggaaggagctacatttacacagtctcatcatcatttgccttctaggtattcacgtccccaggctcattcttcagcctcaggtaatatatttgaaaaagcctaggaaaatactcttttaagtaggttacctgggaaatgattgacagtaaatataaataaacaaatatccagggtttttttgtgtgtgtgtgtgtgtgtttttttgtttgtttgtttgttttctgaaaaatggctattataacacactaaaagcatggtcagtttcactgtggttgcttttcttgataaaattatctctaattctccttatgtacctatttaatttgtattgctattaatgaatcctcaaatacatgaaatctcctaagttgctataagttaatttttttacatgatttcaatggctttttcttttttgcatttgaaggaggaattagaaggtcttcatctatgtcttatgttgatggcttcatagggacatggcccaaagagaaaaggtaaacaaagagaattacttttagtgtattcagattattaagaaatgcaaattgcatctgtgtctctcttttattgataaccaaattgctaaaacttttaattagttcctaaatttgaaaaaggcagtataggcagatgatagagatgtaaaagaggctaactttaaaaagtagctagatagccctccccttaccttgaagacagtatgattatgagaactggggaaagaaaggaaatgtaatttcaaataattcttgttaaatgatactaaaaatcatttctaggatttttaaaggatttttctctttaacttttttttagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggtgtagtattaatctgcatagttttgggcatcttcattagatgagtgtggttgtgttggatattttttttttcagttgacatgcttgcttctttcagtagcagtcccttttgatacaagttcatccccattaactatagtaacattcaagcacactgtggtttccagtatggactcaaagctgtaataaatccttttatcacatgtttagatgtattccttggttttgctcctctactgctctttctcactcacaaaagccttttaaaaattaagctactcagatctcttcagagaatgattccattttgtctcttaatcatgtaacactgccattttttttaacagaatgctactgtagacactaatagatattaaaatttactgcctagagactctgttccttgcagaggaagggaaacaaaggggaagaaaatcattagtataaaacaggcagtacctctgttgcttcatttctattccatttatttacacatcttcaccaccccattactcatctgttggactatggttacagcttcttgactgggctgtctgtctccaatcatgccattccagtcttcatactgctactaaaggtgatagttccaagagcatagctccaattgagtctctttctagtcaaaaatcttgcctgttgaataaagttcaaaccctttagcacaacattcagggactttcacagatgaacctaaatctttttgtctagcttcttccccataattttattttgtattgttctttaagattaacttcaagcttcatctaaagccttttataattccttcagtcgaggtcaaatgtttcatcatttgtgtatctattgtatccttaaatatactcatacctgtcctgtgtcccggagttttcaactgttttgtatgatttgctttgtctcttagaccatgacctcctagaggtgctgcatctttttatttttatttatttatttatttattttttgagacagagcttcgctcttgttgcccaggctggagtacaatggcgcaatctcggcttaccacaacctccgcctcctgggttcaggcgattctcctgccacagcctccctagtagctggtattacaggcatgcaccacaaaataaattttgtatttttagtagagatggggtttctccacgttggtcaggctggtctcgaactcccaacctcaggtgatctacccgcctcagcctcccaaagtgctgggattacaggcatgagcccccgtgcccagccaaggtactgcatctttttatccccatagcataataaagtgtctggcaaactacaatatatgtaatttgatagatgaagacatatgaatgtttgaactaattgcttgaatggtatcttctgactttctccattcagagttaaatctctctctgggtttccatacaaagcctgttgtttgtacctcttctccttgtgattttttaggctccttgacctgaggtaccatatattttaatatatgtaatatctgacactatgttgtgagtatgttagacaccaaagaaatgtttattgaattaagcattggcagggacagttgacaaggagacattaagacagtgaaccacttctacaacagcttgttactttgctgaattctgaagcattttggaagcccgctgagaactagggctgtccctaaggattcaggtagaaactagggcaggcccaggaggcctatagataatgaactagctctcaaattaaaagtactgtagaagggaagtataatcatccccatcttttcttcaatggaaaaatgttcattatagttcagaacctatcaagcagactgtcagtacctcaacttaaaatcatgcagcaatagtttcatttatgtgctacaacattgggtggctaattttgggatgtttttacttgaggtatttttactgagcttatattttaaataaaatttaaatgcaattttaaaaattggtgggggaactacctactgtaagttattaaattagggttaaaaaaaatttgtgcttttttgttttgtttttatggttgttctttgcaaatctcataggttttgacagagtgtaattaaataagtttgcctgtcctcttttttgatggaactgttaccactgtagttccgttcttccttcataatttctcaaccacacccacattcagaagggttgtaatagttcaaactttcagttataggactaaccacaaaatgtgactacaacaattgaaaatgagaatattggtacctaaaatgtttgatcgttttcaatgaaattcgttcttaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggtaaaggaaattgctggcccagtgctagatctgaactttaatgatgcatgggcatatttagaaaaagttggtaagtactcaaagaggtggtctctcattaatttttattaacagatttctttcagagaagtttgtagtatagatagacagctggatcaatgctattttttggtgctttgtagaaatcaatttattttcccaaagtattgcctaattttatatttttatcttaagtttaaggcatctcatgggaaagttctctagaaacattaatttaaataattatatgtttaaaaaacattaaaataactttcctgggagatacacacacacacacacacacacacacacacgacctaaattatctcaaatacctttatttttatttatttatttgactcttccttccctcctttatttacttatttatgcttaatcccatgtctcagcagaatcgtcaagtaccttttaaatgaaccatttattcaccaaggtgatgaaatagaattctcctttctcatatcaaatacataactctctcctgtatggtttgtctttggtatgcagaataagaactgtaaccatttgatttcttaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccaggtaacatagcttattatgaagagtctgttcataaaaaacaccagcttgattggtttgtcatactaacttggttgtactttgatgtgcaaaattggatacacagtttgagattgtgcatgctcccttttggaaaaccaaaatgagcaaatgaagtttttaataaattaaatgtattatgtgtgcatgcatatattcagtagaacaaatgtgaatgctaaaaatcaaatctaaatattaatctattagggaactgtgccctcagatataatctccttgaactattaactgccctttacatacttataaatttaaataaatgttatatgcatgaaatgtacaagaaacatgttggtataataaggaatgcaagatcaagagttcacaagtccctccttcaagatagaaatggttgaaaatccaaacttataatatctggagttgagagaatatattttctttaaaagtcagtatacatactcattattactattattattttttgaaacggggtctcagtctgttgcccaggctagagtgcagtggtgtgatcatggctcactgcagcctccacctccctgggttcaggtgatcctcccacctcagcctcctgggtagttgggactacaggtgagtgccaccatacccagctaacttttttgtattttttgtacagatggggtttcttcatgttgttcaggctggtctcgaactcttgggctcaagtaatctgcctgccttggcctcccaaagtgttaggattacaggtgtgagtcactgcgcctggccatactcttatttttaaaaaaatcttggggggcagggataaattcgtaaaaataaaagaaatctttattaaaaccaaatgccatggaaattttttagagaattctcatagttatactaaacctgaggaaaaataacataatattgactgtttaaagagaactctgttttcaagcctgtaaaactaattgatataattttctacctagaatttagatattatgaaatttttttttgttattgtttttttctttaggatcacagtatcacgtctcatattaacactttccttttggaacgcaagttagttttatcattgtttcctaaaagtaggttccttgctaattttaaataaattgtgtatatatgcatgcaagcatattatgtgtttaaaagtacagagaaaaggaaaagaaactacagaagctcaatttttatatgctggtgttatctaatgaacagactctttgctagttgctccttttaaatttctgattttgtttttattcaggatcatgaatttatcgtgttttttcagtctctagcctttctttggcatcgctgaacacgggtgataacgagagtgtacattcaggcaagaggacgccaaggtaaatctataacgtatgaatatttttacagaaaagaatatagtacctgcaattatacaaactctaagtaaaaattcttcagtgtttttacattttataatgaccaaatcataatcacaaattttactaagttttgctgacttaggactgttagagtttctgttaaaataaattatgtaaagaggtgtctattcatctttcagtgcttgtcttttagaatttagaattattgacattgataacatactttttataagctatgaaacattaacagtaattatacatcagtaattgctaacatgattattaaatcacagtcagtagaatgagagtaccaacttctctagtctattaccaactaagacaaaggagttttccccattagaataattccaaagtgggttgcctatgacttaggaaggatctcttttgtattttctttctctaggattctttctctagattagaagctaaaagtcagtattttattactttatactataatatcatatcagaaaagaacatttctagtgacagtcatcatcttagagttcttatctttgtattaccatcctttgtgttatttgccagttttcacattgaaaaacattcactctttcaacagatatttatagaatgcttactatgttctaggaacttggatgtgtagctgcgaataagacaaacaatgttatattattttttattattaattttttttttttgagacggagtctttctccattgcccaggctagagtgcagtgacacgatctcggctcactgcaacccctgcctcctggcttcaagtgattcttctgcctcagcctcctgagtagctgggattacaggcgcgtaccaccatgcccagctaatttttgtatttttggtagagacgggctttcaccatattggccaggctgatctcgaacttctgaccttgtgatctacctgcctcggcctcccaaagtgctgggattacaggcatgagccaccgcgcccggccttatcatattatttttaggcctttaggttgattttgattgttactttcacgtataccctctgggccccattttttctctgtttgagacataaaacatattttattttctaattagatcagagtctgtagaaggcttcttatctccaagtcgttgtggcagtcgaaatggagaaaaagactgggagaatgcatcaacaacttcttcagtggcttctggaacagaatatacaggttagtgtctatacatttttagagaaacatttgaatttaacacactcataaatggagggtgtactaaagaaaattttattggctcacctttgggtcttaaacataggcaactaataaacagtgaatgcaggtggtcactttcaggtagttcagtaagtttctaaacaaaattagtgatgctacttatatctcatccctctaaccaatgctggccatttctgtgtgtagtttgggtccgaagaagttttagagaagttctacatagttcctcagtactgagtaaaggctagaatccaccaagtcctctccctaatactgggattccaggtatccagaattgtgcacctttagcaagtattaagaggctctaaaagataagaatgcattgaatctaggaaggtatctagcctcacatatcgccaccaagtcctcttctagcttctaggtaggcatgattggaataaaagcaatgaagaatagaatgtgggttaaggacacttctaaataaatgaagcaggagagaaatcagaagaaatgtcagcagcacgttgagaggtaagataggaaggcatgggagaacatgtatggggaagagcagagggaaaaggagatgcctccatctatccatgatagagtggaagtggaaaccctagaaaggcctaaggaggttagaacttgctagagacccactctgtggcttttaatactacctcctaccgccagtctgacagcctttaaggcctgggatttgacagtatttccatgttactcactctgcttctctatgttagttcagttgaacaatctgaaaaagaaagcttttttttgccttttgaaaagacttaaattactcatggacccattctactctaagctaaccagtaaccgtatagatttaagaaagaaggttaaataggcagtatgacagttatagcaatattttatttttagtactgctctcacagggtactccaaaaggccataggaacatcctccatatctctgggtggataaaacaatgttttggttggattgcagccagtaagaggcctttaagcacagaatttggtcttctattacaatatttcagcagtgtaggaacaattacatcattttaaaatagtagtatttctgacttaggaatgttatttttattattgttgttaaatccctaccataggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttgttatgttgtttttgttttttattttaaaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaatgactccttttctgtttcttgaataaaatgtagtttttggtaaaattatttgaacttgagataactcatacagtttttctatcccctaacctatgtttaaatttaataacttgaatattcataacaggcaacttgaaataattagccttttaaaaatactaacttagggcaatgttaaaaagtcggtaactttctatgcttagcacagacggtctacatagtatgatttataaatgtgcttatcttatgttaatcttgctcatactaattcactatcttttggtgaattgatagttatattgtaccagaactagtgctctatgtctttgaaactgaatggccagtgaactcactgatctggagtagccatgagaagctagttcttgaccattattttgtaagtttcactttgattttgctgattctacttactcagaacagagtaaagaaaaaggtgttttttaagaaaaaagagatctgataacaaaactataaaataatcgtcatgcctaattatatacctgaagaaatatctggttagtagacataaatgtggttttctagcttgggacctttttgataggttctgtaacttcagagcacagctatatttccacaatatttccagtactttaattttcagaaataaaaatatttaacccggccgggcgcggtggctcacgcctgtaatcccagcactttgggaggccgaagtgggcggatcacgaggtcaggggatcgagaccatcctggctaacatggtgaaaccccgtctctactaaaaatacaaaaaaaattagccaggcctggtagcgggcacctgtagtcacagctacttgggaggctgagacaggagaatggcatgaacccgggaggcagagcttgcagtgagccgagattgcaccactgcactccagcctgggcgacagagcgagactccgtctcaaaaaaaaaaaaaaaaaaaaccctaagacccaggcaacattagaaaaatgtacacaatgccaggtatggtggtggctcatgcctataatcccagcacttcgggaggccaaggcaggcagatcacttgaggtcaggagttttgagaccagcctggccaacacggcgaaaccctgtctctactaaaaaataaaaattagccaggcatggtggcatacgcctgtaatcccaggtactcaggaacatgaggcagaaaaattgcttgaacccaggaggcggaggttgctgtgagccaagatcgcacctctgcagtccagcctgggtgacagagtgaggctgtgtctcaaaaaaaaaaaaaaaaaaaaaaaaagtgtacacaaaccctagagcccccacacaataagaatgtgttgccttatgactgaaattgatacttcttaactagggcagaggaaaatattctgtagtgaataggaacaaacacctttatttcatgatctgtctacacagaaagatgataataaaattcagcaaaggaaatgtagctgtaatgttatgacctaggaattggctattggagaaacacatctataaaatgagtgtgaaattctgtcgtcccttagaagtatatagatgcttaagaaataggtatcttctcaaaagaaacaaatgagatattaatgattttgcctaatttgatgggggtgggggaagtacacagattggtatgtcagagttgctcttcaaataaggagatctagaatctagtttcagtcacttcctttttgcccctgtgggcatgtaggtcttctagcaactcaaggccacatgcttagacaacacagattagttttgtacatgtgtttaaatcactgtggtgatatgtgtcacaacaacagctaaaatcagataactttattccatctacagtggcttatttatgtcaggaaaatagggggcaattattttccatcaaagaggtgaaaagcaaattaagaaatgttttaagacccactaaggtttttttttttttttttttttggggacacattaagcaaagccaccatggtaccttaggctactaatgcatttgattcttcttaaccccaacctgttgttttaggtgattgaacctgtgattcagccttcagtaggtgttagaggcatccaacacaggtggcaagtatcgtctacagcacctctacttcacagttacattcagctgctgtgattcctggccgaccctattattcatacttcagggtttgtgtgtttatatagaaaaggaaatgtggctctcaacccgagatcgcgctgctgcacttcaacctgggtgacagagtgagactcagtctcaaaaaaaaaaaaaattgctttataatttaaaagattctttgctttgctttctcttttaacttactgctgcctgggaggaggtgagcatttacgtctccattctacagatgaggaagatgaggctttaaaaggttagtagctgtcccagggactcaaagctagtaagtgacagcattacaagtggcacctaagccttctggtttcaaatccccttactgtgccatatggtacagtttcccactgcgttgtacatgttgtggaataagaataaggctcacagctgttactagttaataacgtattcaccattggtagaaaactcagaacttgtggttaaagtggattttgttctcttgcccaagactgttaaccatcatcaacacaacagctaaaatcagcctgttacgctcacctgctgtttaatatctagattcataaagatgagagaatggaaaaactgcaaaagtggtgaaaacaaattctgataataggttaatcagaattatctaggaaacagttattagatgaaaggggctaggtaggtcacaaaggtaagttctcttccatcaaggaactcttgaagtggatgccattagacctttacaaacaacggatataccgtgtgctgtattagaggtatggaaccgaaagtaaaggacagatgcgcccttgtcttgtcaacagtaagagcctcttgtccatcaagagaattcatgtactttatagggtactaactctactaaaactaactctataaagaacttaagactgctcttcctggggaacttgtctacaggcactcagaatggtccagcatttgacatactgtcataggctttcctacaatacagcctctaacaaaactacgcgaacccctggtaatagaattgtttacctttataccaagaaggttgggaaagcatcaaaatctgcgtgtggcgtgtgcccaggcagactttgaagggtttgtgctgtaagacctaaagttcttatgaggttgtccaaaacaaagaaacatgtcagcagggcctatgttggttccatgtgtgctaaatgtgtttgtgacaggatcaagcgtgctttccttatcaaggagcagaaaattgttgtgaaagtgttgaaggcacaagcagagtcagaaagctaaataaaaaatgaagcttttttgagtaataaaaatgaaaagacttgctgtatggaaaaaaaaaaagactatcttacgttgtcagccaacaggataccacattaattctttaaatactgaattttgccgggcgcggtggctcacgcctgtaatcccagcactttgggaggctgaggcgggcagatcacgaggtcaggagatcgagaccatcctggttaacacggtgaaaccccgtctctactaaaaatacaaaactttagccgggtgtggtggcgggctcctgtagtcctagctactcaggaggctgaggcagaagaatggcgtcaacccaggaggcggagcttgcagctagctgagatcgctctgctgcactccagcctgggcaacagagcgagactccatctctaaaaaaataaataaatagtgaattttgaattgcagagacatcagttctgttgatagggccttgaggtcctcatttatgatgagaacaaaactaactaaactgcatcctctttcttagccagaggctaagtacagatatttttgtatacattacgaaatgagtttgtacttggattctttatccttatagtctcaacacaatcggtattcaataaatattcgtcaaatgaatacatgaagggaggactatgcagtcctggcccaaaattcaaaatcaaattcaaaacatgttctgatttcttctaggtcacccttcatttcttactatagatatttttgcccccaaaatacaaacccaaagttggcttttctgctctgactccccctggttcatgccatttcaaaggacccaggtgcagcttgaaaatctgacctattggtcaccgtgacacaatgatgtactgttcctttttacctctctccagctcctctcacaaattatgggccagtctcaaggctcagttattcatgttctgctgtctccactctttccaagaagggcttcaatatcagctttgactgacacctccattcagaatctacatctccagccctgaaagcttcctctgggcccactcatgcatctaactgccatctcaacattttcacctgggagttccaaagtcatcctcaacttaatctgtttaaaaaccaaaagtcaacctgattttacaacttccttataaaagcaactctccttcctgaaagccagccaccaagactgaaaggtcttatcccttgtctaacacagaagacagcctcatgcacagacagccaccaaatcctatcaaatatttttactttgaaactgctcctcatccctgctgccaccagcttcaagtccaggcaccaaaagcttatgcctaactgcaagaaccttcaagtggtcttaccctaattcgatttcaccctccaaagtgtcttgcaaaatctaactttcttagacttatcttaaaagttcaacattgtttttattttgaattgcggggaggatgggggtggggtgttgaggtggtggtaatctgttcagtgcttggaaccactaaaggtcttgatcctgtttttcaggcggctcctatacacagacctttttcttcagaaaagctgacctgcttcaatcttgatagaagtcaggatatcacaatctgccttatatcaaagttatttgtacattatagctaatctccaataatgtgtaagcttcctgtaaggatgcaccatgtcacattctttgtatctgttacattacccaataacagtgcttgccccacagtaagaaggggctgtttacaaagtcaactggaatcaaatgtgatattaagaattggttttggcccgggcgcagtggctcacgcctataatcccagcactttgggaggctgaggtggacagatcacttgaggtcaggagttcaagaccagtctggccagcatggtgaagccttgtctctactaaaaatacaaaaactagctgggcatggtgttgcacgcctctaatcccagctattcaggaggctgatgcaggagaatcactcgaacccaggaggcagaggctgcaatgagccgagattgcaccactgcaccctagcctgggtgacagagcaggactccatctcaaaaaaaaaaaagaattggtttcactgatcagtagcaggatcacagcactgtagagggaccctctaccaatgccaagggaatgctgccaaattcctcctgcaaatacttggaaatttacactaactctctgtgaaatcactgaaaagtaatggcaaatcataggttagaagctcctgtgggcagaataattgctacaaagagaaaacgttactttctttccaaacaaattctggggccatttttatattggggatgtccctattgcttgtcttttaagtttctgatggttttttttttacctttaaaaaacgttcgagctacaggaacctgcagtggaagaaaggagtctcactttccttgaaagctacactcttctcctccagcctcccctcccttccctgaccccctcccccatgtcccctaagaggcatcaatgatgtccggggtagatggggggccctgggacaatcacacagctgcaggccacaaggctttcacattgagtcatctccttagcagtgtgggctgaagccgagtctcatgtctaactcagatgatgccctttcccagctaccccgtatttagtacctgaaagtttctgaagtaaatgaacatctgaaacattctgcagggcctctggcatccagggtggggctcctcatctggtgtgtgccagccctcccttagatgttgagggtgcagggtaggggcaagagctattactgtcttctgtcctctaataccctgtccctaccaccctccccgccccccgccccccaccccactcacacacacggcctcagggctatgtggtctatgggaaacctcatcttggtagccagtcagtaatagtgaataaaatagaggactccccattcccagttcagtgtttatcgagagaggttgtaaaaacaaagagatgtggctttgcaagattttcctcacactcaggactcaagttactgttaacctctccgtcatccgcaactgacttggcataaggccacctgtctgtgcttgggtcctgtcagcagtttctctgcagcatccagactgtcaccttgtagaaatcaccattaggataataccaggcaccagacactgtggtggtcaaatcttgaagagtcaaatcttgggagtctctctttatagattcccaatccaatccccaaaacatttacttaccacccactatgtggaaagaaagcactgtgacctggagggtaggagaagcagcgcaagcagctgagtctagcagcaggaccaccagaaactagagccattcttcacgatgctgccagccagggaacggagtgagcccatgagctccgacccagcatgggcagcaccttccacaaagggtgcctcatttgatcttcacaacacccctatcgggtagatactatcatgcctattttaagatgtggaaactggagcccaagatcacacagctatcaagttataaagctgacatttaacctggactctgaccactaataatctgatctgcgtgttcactgatcagaaacagacaaaatgacatataagaaattgatattggccgggcacagtggctcacacttgtaatcccagcattttgggaggccaaggtgagaggatcgcttgaagccaggaatttgagatcagcctgggcaatataatgaaactgtgtctctacaaaaggtaaaaaataacattagccaggcatggtgctgtgcacctgtagtcccagcttctcaggaggctgatgcaggaggattgcctgagctgaagaatttgaggctgcagtgagctatgatcacactgggctacactgcagcctgggcaacagaacaagcccctgtctattaaaaaaaaaaaaaaagaaatgcatataataaaaaaaagaaatgcatataataaattctatgtcacaacacagagcaaggttttaaaaatatatattttaaatttaataaatgatgttaggaaagctggatagaaatatgaaaacatcgattacacaccaggtaaattttaaaatactaatgaaaattattttttaatgacagactgaatcttcttacattgtcaaagagaaagtaacattctaaactctgaaattgctaatagcaacaaatttgactatatgaaaatgtcaaactaaaataaataatagctaagaaaagaatttggaaaaatatttgaatcaagtggaataaatcatgactcatcctaaatatatagtttgtacaaattaataagaaatacatagattataataaatatgtgaaggacatgattagaatggttcacttaggaaataaatagattttccatcttatttataaacaagtgcaaattgaaatgaggtaccattttacctcactgcctattacaatggaaaatatatgttaccgatgaacatctctaagaagactgtgttgaaccttatactctcatacaatgccagtgacattctaaactgctaatcactgtaaacatttgtatcaagcaataaaaattttcattgcctttgttacaaaatttgtatttataacgtgttttacaacatatttatataaatgttatatttatacatatttatataaatatgttatatttgtacatatttatatgtatataaatacatatttatatgtacttatacaagagcatttatgttataaaaacaatataaaaaagtcataagtgcaattattcattacaaatttctataacagttaaaaatactagaaacatcctaaatatccatatttaagggtttagaaaattaagcaacatagactcatgtggatttatatgatattaattgagaatactgtgtacactctaattacagatacgactttgaaacacctgtgtaaaaaatgtgaagaatatctgaaatggaatatttaaaaatagaaaatctaaaaataatgagattacaaataaatacttttgaaaatgtccttcactggctaagtttggttgtgtaggggtagcaggtccaagatgacgactacttctttattctgtaatgtattagatggcttttatgattaaacataaaaaggcaaatacaatttacttaaaatgttaagattctttgtacagaaaaattaaaattagaaaaaataagttataagaacttaaatataacctgtaaaggggcagaaataaacctactctcgaaaacaatttagcccgaagcattggatatttatttaaagtatctcctctgttttcaggcttgtgctaatcaccctgatgagtagaaagaagctccccctcgccctgagaagttcataatcccatgggcaaggcaagacggagccacgtaacagttgccctggctccagcagtgcagagagaggaagtcctcttagggatggaggttagagaaggctcccaggggtgggatggaggaagagggaagacttcttctgctttgtccacacctgttagagagcatggccaggattcccagcctgtaagggtgagtgtttctattagttgacttgtgtgtaatcctgtggggagtcctcctgaagggtgaaagagcagtcttgtgaagttggccttggtcactgaaaccgggctgggcaccccaggagaccgggcctaaggcagtgtccctggctctgacctttgctgtttcttctcatccagacaagttcagtaaggcccatggacagcacccaggcctcagcagagaaaattcagcatatgctctgggccacagacttcccttgggtatgagatgatggcccaggaagcaagtagctctgtgatttttaaaataacctacttctacttcccctcaacccccttcctatattcccctcttggtctgcttgccccattctttgttttcacccggcggcttctctgctgttcatctctagctttcaggatcactcacactctctgagcccgcagactgaggtgtgcctgaaggggtgaagtccagcaacactgggtctgtctctgatggtctctgggctctggcaggcaagcactgcccctgctagccttctaggggaggaggctgcagccccctactccaccccggatgtgggcaccgctcaccagcaaccacatgctcagacattagaaaagcggctctggggtgggtcttcaggggaaaaccaagcccggaggctgaaaagccagtgaagggaaggtccagaccattcattccctaggctcttctcttccctgcccatcttgtaattggtgtgggagaaattcttgacaggagcagcctaaacactgcatacccaaccctctgtgagctctaggaccattttctttttgagatggagtctcgctctttcacccaggctggagtgcagtggcttgatctcagctcactgcaacctttgctcctgggttcaagcgattctcccacctcagcctcctgagtagctgggacttgcgcgtaccgtgcccggctaatttttgcatttttagtagagacagggtttcaccatgttggccaggctggtctcgagctcctgacttgaagtgatctacccacctcggcctcccaaagtgctgggattagatgtgagccactgcgcccggcctctaagaccattttccaaatccttcctggggatctccgtgtgccagagggaccctgagcgagggtgaccttatgtcccagtttgcccaaaatagtcctggtttacggcccaggttaattctgatagtgcccctttcactctcagaaacatcctggttagatgataaattatttcatgaccccacttcaacatcaaactgaacacatacacacatgtgcctctctgtgttcttggcagttaaggggacagcgtccatatagtccctaagcagagaaaccccaggcttatctttgactcctctttgtgagacctatgatgttacaattatctcttgaatataccctcccatttctgtccccactgctcatgatctatttcagacacaaataattacaacctactatggggtctccctggcttgagcctctcccttctccatagttctgccagcgatcttttcaaaacacagatcgatgcctcctggctccccatgacctatagattgaaatccaaatcccctcatgatcctttcctgcttcatctcctgcccccaccttcctaccctgggctctggcagactgcttgtcccctgaaaagcccacattcctactcattttggtatacttgttccctttactccctcctccgagtctgaccctttcttctcttttctgctgctcttatttgactttcagctccttcctgggactgatctcaagtgtcatctcctcgaaggccttttctgattcagccctcccgtcaaaaataatcactccccctccactaaaccctaagagggcttggtttttaacatttactacaatttggcccctgcataagattacataagattctgcttatgtaaccatctctcctgcctatgcaacaaactgcgaaggccaagaatggcatctcttgcagtgcctgaaacagtgcctgcttcatggaggagttcattgttaacaagtcttaatcgaacaaaattgataatccacctcaaattttccacaccgggttgcccggcacatcagccactcatacctgggaacactggggacagactcagagggcactgtgacatcagttctaccacaatatcttgtggaagggatatctgctaagaagaattcagatgtaagtggctgcatgcctccttcaggagaaagagcaagctttccctcacccatcctctcctccttaggtcccactgcctcctcagggtcagacttcattccccctcgtctttatgaatcctccccttactctcagtttctcagttcagaagggatcttgctgcctccaagctcctgactcataatttaggacaactaatctggtgtttcattaggtgtcatcttttgaactgagcttacatctgtgtctggcttgacaggttttttaggataggagaagacagggaagaggcagatgtgaatcccaggtttcacccctttccagcaggatgatctgactacaccccttcctcgctgccttaaaaccctttcgcgtggcttcatgaggacctgactgggtcagagaagccactcatagggtgaagacatgagccccacatctcaggacgctaacaactgcttgactgcccagggcgggctcccccacccacccagatctgctgtgtcccggcagtggagtctttcctagggaacaggtggatttggggtggggcgtgccttaggccccatactcataaaatcccggggctctgtcttctcacctctaaaacagagaagacagcagccggtgggtgcaggtgggaaggggtgaagtggaggctgagaagaggttagggctctcgggcacccaccacctcttgcaacgcgaccctgagacagtggggcaagtatcccgatttcacgaacaaagaaactgagcaactaatagaggaatgggccacgctcctactgggaggccgggcaggtctcccagccctgaagacttttcctcccaagatttagatgtgaagccccttttgcctgtccctgcccttacccctcgggtcagccccaaatcggaggccaccatctctctcacagaagcctgcccctcccaccccatcccctcctccctcccctctttcctgcccacccatttgcctccggcttgggtggcaggaagggaggtgcagggccgggcgtgaagagcaaaccccctcctgctcagagctgctgccgcctgcgcccagggctgcactccgcgcaggcctcatagccaggccatggcccccacagagccctggagccccagcccggggtcagcgccctgggactactcggggttggacggcctggaggagctggagctgtgtccggccggggacctgccctacggctacgtctacatccccgcgctctacctggcggccttcgccgtgggcctgctgggcaacgcctttgtggtgtggctgctggccgggcggcggggcccgcggcggctggtggataccttcgtgctgcacctggcggcagctgacctgggcttcgtgctcacgctgccgctgtgggccgcggcggcggcgctaggcggccgctggccgttcggcgatggcctctgcaagctcagcagcttcgcgctggcgggcacgcgctgcgcgggcgcgctgctgctggcgggcatgagcgtggaccgctacctggccgtggtgaagctgctcgaggcgaggccactgcgcaccccgcgctgcgcgctggcctcgtgctgcggcgtctgggccgtggcgctgctggccggcctgccctccctggtctaccgggggttgcagcccctgcctgggggccaggacagccagtgcggcgaggagccctcccacgccttccagggcctcagcttgctgctgctgctgctgaccttcgtgctgcccctggtcgtcaccctcttctgctactgccgcatctcgcgccgcctgcgacggccgccgcacgtgggtcgggcccggaggaactcgctgcgcatcatcttcgccatcgagagcacgtttgtgggctcctggctgcccttcagcgccctgcgggccgtcttccacctggcgcgtctgggggcgctgccgctgccgtgccccctgctgctggcgctgcgctggggcctcaccattgccacctgcctggccttcgtcaacagctgcgccaacccgctcatctacctcctgctggaccgctcattccgagcccgggcgctggacggggcctgcgggcgcaccggccgcctggcgcgaaggatcagctcagcctcctcgctctccagggacgacagttccgtgttccgttgccgggcccaggccgcgaacactgcctcggcctcctggtagctgccccgggccgctggaggtgggcggcagcggagcatcgagaggaggccagaggtcccggaggggactgagctccccagacgcgcctgttctggcggcagcaagctgctcgggccggcatcgcatttcctcgcgcgctgcctggactcccaaggcctcctccatcggtttccccggaacctcagaacaattgaactcccctaaaccaggctcctgtgactagctgttccctctcagcctgcagggtacctgagctaattttgtccagtccaagataggtgctatgagatgtagcagacagcaactcggagacccgcagattcaccaagtagacagaagggaagtgggtttccttctctgtcccatcgggaagagaacccaccagaatatctaacccagacccccaaatgccattctgatttctggctgtgctttctcccgtctcccacaatagccgttgctttcagagaaataccttctccaagtcagaccccctgcccttctcactcacaaaacccttgcattgaatctggtgacacttctccccctgtgaagcggcaggactcacctggaagttgttctggtctttccctctggacagaaggtcctgaaatcgctcaccaggcgttttttgaggtctccatcactcagccaggaacctcaaaatctctgtgaattcatctttctcaataaacactcttgctagccctgtcttgacaaccgtctttgcttgagcagtgggagtgaaatgcatatcaggaggcgggtcgtacactgggtgagacaaaactcaacacagtagttgaggttgatctcaggatgatgaggatttggggtggtgtctgggagcatgagagctggctgcactctgcaggtgcagtaatcccacaggaggaagcaagtcatttattcttatttttaaggacatttcacattttgaaaattaccgaaagaaaatatatttatataagggcatctgccagccaagtgtcacttccaagagaagatgtgtcattttggattttcaaatatataccaggccccccctttttttttctatcttttttcagaccttccagtacaaacttggaggattagccattttctgactctgtcatttctcatttgaggtttctgtagggtttggaaattcactgtttatacttttgatttaagaggatttggcctaaagacatttcagtcagtgcacatcctagccagatccccacaggccagtcttgatgttgcaagctctgggggaacgggtgggtgtgcacgcacatcagcacctcagcactaggttgggtctgaaggctggcattctgtcgcaggctatccatcccatccccccatcaaatacccctgtattctcttcagcatttggagctgcttggattgaacatcggctctcctaggtcagcctgccaaaaagtgcatctctgcatgttcctaccatatactccaagagaggcaagccttgcagcctgtgaggtcacctctgccagcaggacacatttcaggcacttcggtgtttgagagttcagttaagtcttggcccttcctatcctcacgattgctctccgaggcaagaaattattttttcatggggctgagaccccagaattttcagggcagggaagctgattctcatctgggtttgtgtgtgacaagatctcagagtacagaggaggcacttttctaggctattgggactgagcccccacctccacccctgccaagttgctgcttctgacttactgactagttgagttccctgaaaacagacaggaagaaagaagacttctccatgccctggtgggttttcgtctcccctcctgcagtagctattgaaactcagcattcccctcctgctgtggaactctgcaatgtggagagacagtttccgccctttgtttgagtagatcacggaactggtctaccatgtgtcctttggaaattttcccttaaattcagacaaaaatgaaagaggatcagtgagctcccatctcccactggggaagatgaggctcagattcatcgaggaactggttaaacgagcattcccacatatgtggctggtgagagtagattcctttagaaagcaattgtcaatcttcatcaagagctttagaacttttcatatcctgtttatttaaaatgtttatacccttcgaccctgtagttttgcttctgccactctcttctaatgcaacagtactaaatttaaacgattctgcactgagttatagaagtttttttgttttgttttcgttttttgtttttttgagatgggatcttgctctgttgcccaggctggagtgcagtggtgtgatctcggctcactgcaacctccacctcctgggttcaagcgattctcctgcctcagcctcccaagtagctgggaatacaggtgtgcaccaccacgcccggctaattttttgtacttttagtagagacagggtttcaccatgttagccagaatggtctcagtctcttgacctcgtgatccacccaccttggcctcctgaagtgccgggactacaggcatgaggcagtgcaccctgcggctgagttagagaagtttttaaagagttaaacctgaaaggaaacaacaatgtccaacaacagtgtaatgtttttattaagatgaatgactattatgcaaatttaagatgctctttaaagagagactgaaaaatgttgacggataacttaaaagggaaaaaaaggtaaaattgtgtctgttaaacacacccacacacttcaagtctggaggatgtaacatggttagcactggttttgttaagtaaaacataacatgcttcatagtccttttgatgaaaacgatcttttgctcttttatttctcatagctcaagctttgaacactataggtatatctcttttatctaggtgctaactaatggaatgctgtcgatttatttcttcgtttcttgcttgtccctcctgtcaggatgcaagctccatgcatgcagacggttttgtctgttggttcaaggctgtgttcccagtgcctggagcatgcctgcacatctcaggcactcactaactacctgttgaatgaatgatcatcaggaccatgtcatgatatgaaataatgtcatagaatgtgaagagtaaaaggaaggctattgcattttatgtgtaacagctatggattgttaaaggacttgcaaaaaaaggctaggaagaaatacaataatcattaatgataatgattgtgtatgattgtgttagagtaagtggattttagatcctttttcccctccatttctttacttttaaatgttctatgagctttttttttttttttaaagagacagtcttcctgtgcaatcatagcttgctgcagcctccacctcctggcctcaagtgatccccccaccttggcctcccaaggtttgctaggattacaggcatgaaccactgtgcctgggtttataagcttcttttttttttttgagacagagtcatgctctgtcacccaggctggagtacaatgatgggatctcagctcactgcaacctcctcctccctggttcaaacaattctcctgcctcagcctcccaagtagctgggattacaggctcccgccaattttttaatatttttagtagagatggggtttcaccatgttggccaggctggtcttgaactcctgaccttaggtgatccacccaccttagccacccaaagtgctgagattacaggcgtgagccaccatgcctggcccctataagcttcttttaaagggcagttaacaaatagcaacgaagctaccaaagcactggagctcataacaagctgcctgtccttggccacctcgcttacctttcttgagactcactttcttcatctaaaggatgaagatgataatatctcctcaggctgcctcacagatcaaaggaaataatcttgaaagtactttgtaagctgtggtgttttagacaaacatactgcaggagttttagacaacataccctcaggattagcttgttccaggccgggctaccccatcccaatccttgtagccatggagaggagatggggtggagccactctgggttttcaaaaggtcagcatctaggctaaggctgggcacactggctgtgtgtgattctgatttgcttcttgtgactaattctgggcttcctcctcacctctctcaaccccttgggtgctttcttggggcacagtgtgggaacccagggcacttgggttgatgagtgatttggggagttcagcagaatggcagagctccaggggtggcacttggtgatatgactcagccccacaccactctgaaggcagagtgaggactctggacacttgtgagtacgtcttgcttgttagagcttactggggctaactccctgtcctacctgggccgagtggccacaagacatacttatcccatcacccccaaatgatggggcaaaaggtgcaaatgatgaaaagaccaggaaatgcttgggatgtgagaggaaaggagaaagcaatgatgtgaaatcacccctcctcttcatcatcatgaacatcaaaaagtatttattgagtgtgtaagtacatcttccatgaaagtgggcactgcctgagattcatatttacatccatcacagtgctttaaggacagaagctcattttgtccattctgagaacgaggagactgagggccagaaatgggggtcacttaaggtaataatcaccacttatacctgtgtagcatattaagaaaaaattctttttttgagacagagtctcactctgtcacccaggctggagtgcagtgacacgatctcagcttacttcaacctccacctcctgggttcaagtgattctcctacctcagccttccaagtagctgggattacaggcacgcgccaccatgtccagctaatttttgtatttttagtagagacggagtttcaccatgttggccaggctggtctcaaactcctgagctcaagtgatccacccacctcggtttcccaaagtgttgggattacaggcatgagccaccacacccagctgcaaatgttttaaaagcagcctgggcatgggtagctcacatctgtaatcctagcactttgggaggccgaggtgggaagatcgcttgagcccagcagttcgagactggtctgggcatcatagtgagactctgtctctaaaaaaattaaaaatggccaggtgcagtggctcatgcctgtaatcccagcactttgggaggccaaggcaggcagatcacctgaggccaggagtacaagatcagcctggccaacatggtgaaaccccgactctactaaaaatacaaaaaaattagcggggtgtggtgtcgggcacctgtaatcccagctacttgggaggctgaggcaggagaattgcttgaggcggggaggcggaggttgcagtgagctgagatcacaccactgcactccagcctgggcaacaagagcaaaactctgcctgaaaaaaaaaaaaagacaaaacaaaaaaaaatttgtcagtttggtgtctgcccaacttaaaaagaaaatatttactatcttgttatattatttcaaagacaaaagccttttatacataatatctcattacaatatccctctgaagtagatgtcaagataatagctaatatttactgagcgcagttgagaggctctgagctaaagttcttactttatatatatatttatataatattattaatcctcacaataactttatggggtatataatattattgtttctattctacagattaaaaaaatgagttctggagagtttatataactttcccaaagtatcttgcctaaagaacctgtgttattatccccattttagataggagagttagaactccaagagctcagttgacttgccaggatcacacacacacagggcagggctgaaaattgtggcttcatgggccacagctcaacccaccttccaacttccaccagttttctagtgcccgctaaccctgtttctcactaattggtactaaaccaagtgtgccagagtcaaggctgttgcccagcatggaaattaccccgcttttgttctcaaaaaaatcagaatccctgtcctacggacatggacagtaaattgttggggcattggattgagagagaaatggggctcttcccaggggtgataggggcaggactggggagaaacccacaaaccccagggttgcctggtagtcccagcagtgaatgagagagctggggaaagacgggcagggcttcaatgggcttcgatggacctcagacaacagctgccagtgtctggatggagactgtggtttgcctcagggagatgtgctagacaaggggtgattaattgctgccctgctctgaaaatgactgtcttcatgctgtgcatgcaaccatttctttctattcatcatctctgcttctgaataaccttaagcaagcaggttgtgccatgggctgctcttattctgggtcccacaaacacagagtggcaggataaggaaggtcacagggcactctgaattccgtttctttgtaggcaaagtcttattctttatatagccaattgtcccaaatcttcgtaggtttctttttcctttcttttctttttctaagaaatggggtcttgctttgttgcccaggctggagtgcagtggcacaatcatagctcactgcagcctcgaaatcccaggcttaagccatcctcctgcctcagcccaagtagctgggaccacaggcacacacaccatcactcctggctaattatttaaaaatttgttttgtagagatggggtctgtccattttgcccaggctggtctcaaactccggggctcaagctatcctcccatcttggcctcccaaagtgctgggattacgggtgtgagccaccgtgtcgagccttctcaggtttcaatttctaaaattattattatcataaagagagaaaatataatatcaagagtgaactaactcaagatcctgcaccctaattgcaataattttcatttttgcccatcctcttaacccttctccacatggtcacattttacattgctgagatcgtgtcgtgtccagctttattattttgcagaacatattataaacattttcctgtgccactatatagatttcatagttgtcatttttaaaggcgtcattcagtgtatagaccacagtataactaaccattcttccatgattagacatttatgttgctcaggagcctctgcttttataaatataccataacaaacatcatttctatctaatttgggactaattttgagtgtctgtttcaaactgaaaaaattcccctgcatccatcaccctcttttgggttcttccccctcaccaccctgtgtgattctctcgcctgttatgttctccttcaaaagattgaaacctcctcaaaagcagtagctgtggacttgtggaaaacgcactttgaaaagaaatagagcacactaggccagttgcggtggctcatgcctgtaatcccagcactttgggaggctgaggcgggcagaccacaaggtcaggagatcgagaccatccaggctaacatggtaaaacctcgtctctactaaaaaaatacaaaaaattagccaggtgtggtggcaggcgcctgtagtcccagctactcgggaggctgaggcaggagaatggtgtgaacccaggaggtggagtttgcagtgagctgagatcgtgccactgcactccagcctgggtgacagagcgagactctgtctcaaaaaaaaaaaaaaaaaaaaagagcatactaatgagtgtaagtgctttttagtaaccatatatagacgttcagggcacaaactccagtgccactagctgggttcaagttccagctctgcttcttactgtctttgagatcttgggtatgttactcacttacttttccccttgggatcctcctcagatcacaggaggaggagatgatacttcttaagtcacagagtttgtgagagggtgaaatgtgttgactatgactatctggcacatattaagcattctatgtttgctataattttaagagtaaaattgaattctaccatggttgtggatttctcttctctctctctctctctttttttttttttgagaccgtgtctcactctgttgcccaggctggagtgtagtggcacgatcttagctcactgcaacctctgcctcccaggttcaagcaattctcctgcctcagcctcctgagaagctgggattatagccgcccaccaccacgcccggctaattttttgtatttttagtagagtcggggtttcactgtgttggccaggctggtcttaaactcctgacctcaggtgatccgcctgccttggcctcccaaagtgctgagattaaaggtgtgagtcactgcacctggccggatttctcttcttaaattcaatgtttcaagaaactttcattttgcattactactgtgccaggtaggatatgcaagactgtggggctacagaaatgaaaaagacggccgggcatggtggcttacccctgtaatcccagcactttgggaggctgaggcgggcggatcacaaggtcaggagttcaagaccagcctgaccaatatggtgaaaccccgtctctattaaaaatacaaaaattagccaggtgtggtggtatgcgattgtagtcccagctactcaggaggctgagacaggagaattgctggaacccgggatgtggaggttgcagtgagccgagatcgtgccactgaactccagcctgggtgacagagacagcctccatctcaaaaaaaaaaaaaaaaaaaaaaaaaaaagaaagaaaaaaaagaaaagagaaaagaaatgaaaaagactcccagctctcctgcagagcaaccatgaataatttgtctccatcccacaccaaaaaagaaatggaaaatgtgggcttgtgtggatcttttgttttgggtaaaatgttatttttcctttcctatctctttttcttgaaattaaaaaccatacaaagaattccatgctgtgaatcggttgcttttgtatatctttgatttttggagatcagttggtcagtgtgtccccacagtgaaagactgtgaaagactttgtctctctgtctgggaatttcctgccagagcccagagtggtctctgaaatgagtgaggctgtgtgtttaatccacagcgacagttttgtagcggtgccatctatctacagacaaggccccagcactgggtggggattggataaggagacctctctgatccctgtcagccctaagatccccaaatcctttgactgtaggcctaagcctgttctctagaggcttgtctagtttattgcttaaaattattttttaacatttaataaaatggacccatcaaaaggctagaagcagacaatcatcaattaaaaatcaaataatcagatcaaacaatcaggcaaaacaattttaaaaacccatccattactatgaacaaccccatcaataggagaccaaagaaagagaaataactgacagcacttagcgagtaaaatacacttatcagcccacttaatacacactttgtgacatgtaagagcctgattctatgtggtcctgtaccaagagagatatgtgcacacatactttatgcattctcagaggttatggtctaaggaagacaacagagcagagttggcagagggctctccagaatgcggtactaacaaacagggaagttatttttaatacgtaatcaatcaatacgggtgtctttatgggattctcttatatcacaagctgaatttggaagctagatcggtaagaagctgattgatcacattttatgaagtttattgctttttaacagtaaaactcattttagtagaaatagcaaatcgccttttgcaacctctaataaaataattgattcaggcaaaaatcatcaatggctgctaaaacctttgggtgagaggcttctggggagctagactattgcaagatgtcaacatgttgccccacagattctctcccagtgagaagggggaaaatgcaagatgatgatggaggggtcaggctgtcaacatctgaacccactgatgtacttagcattgctaaaagaggacaaacagacatgacatgcttcagaataggagcaggatgaagcacccagcattacctgtgaggtacttgccagaaaatgataaacctgaatgtttgcaagcctttggtgctaatttccatgttttaggaaatataggggttaggaggagttaaatgacaatgtgaggacacagacagataaaacagaatttaggacatttcatgagacaactgacccgatttctttaaacaagtcactgacatgattttaaaagttgggggatgcagggcagggaacaataccagattaaaagagccaaatgccatgtgtagatcttactggatttagatacaaacaaaccaaaattttattttatttttttgagacagggcctcactctgttacacaggctggagtgcagtggtgggatctcagctcactgtaacctcgacctccctgggctcaggtgatcctcccacctcagtctcccaggtaactggaattataggagtgtggtaccacacccggctaagttttgtatttttcgtagagacagggtttctccatattgcccaggctggtcttgaagtcctgagctcaagcatggaggccagcccaggcctcccaaagtgctgggattacaggtgtgagccactgttcccgggctaaccaactttaaaagacagtatgaggacaactggagaacttggaatataacttggtattaggtgagattaagaagtgattgtgataatggtcaagcgatcatataagaaaaatgtccaattattttcagagatacattctgaaacatttattagtcatatgtcaccatgcctgggattttctttaagatatttcactaaagaaaaaaatagtcccggtgcagtggctcacacctgtaatcccagcactttgggaggccgaggcaaatggattgcttgagctcggaagttcgagagcggcctaggcaacaaagtgagaccctatctctacaaaaaatataaaaattagccgggcatggtggcgcatgcctgtggtcctagctactcaggaggctgaggtgggaggatggcttgagcctgggaggcagaagttgaagtgagctgagattgtgccactctactctagcctgggcagcagagccagatcctgtctcaaaaaaaaaaaaaaaaaaaaaaaaaaccaagaaaaatgaaaggtaataaagaaaaaaaaactataaaaaagaaaaaatcatatagggaaatgttaatctttactaaatatactagatgtaggtgatgggtaaatgggagttcattccatagaactgactttcctactgagccctgtctcaccactgcccgagcccacagggctgtgagagcacccacaacgctttggtgcacacatttttgaacaaacgaatgaaactgcattgacctaaatgaaccaattgcagaggggtgtggacgagtgtgggttgggggcagagctctgaggagagatggggaggaggtcacacgtagctgggtttatggaccatttcaatggatttagacagcatctgacctcaattaaaaccctcctttcttcaaaaacacactcctttctcatctctttgagtattttaagacaaggcaaaggtataaggtcctaatttgtttttatataacccatgccaaggccataggcccaggcctgatcacagggggagattggtcttttgaagccccaagttgttaaaccacaggaagtggaacttggtcaccagtaaacaggtctggaccattaaatttgtaattatcatgagtaaatactatcttgtttttcctgggggttgggtgtgaggaagaagaaaaactttaaaaaaaaaagataatttggaaaacatcttctttaaaaaaccctgccattttattgggtgcttactatgtgcaaagcacaatgctcaaaagcattttatctgcatgatttcattatcctcaccacagtcacgtgagtgggccttctcatgcccattttacagatgaagaaactgaggcgatctgactacaaaacacatattttaaaagtttcccccaaattatgtacctgagccacgcacttaacattcacaggataaattgataaaaagccccaaattgttcaggtgctatttatttatttatttatttatttatatttttatttttagatagagtcttgctctgtcgcccaggctggagtgcagtggcacaatcttgggctcactgcaacctccacctcccaggttcagtgattcttgtgctaatttttgtatttttagtagagacgaggtttcaccatgttggccaggctggtctcgaactcctgacctcaggtgatctgctcgccttggcctcccaaagtgctgggattacaggcgtgagccactgtgcccggtctgtcaggtgctattttagagggcacctccagcccaaggtctttgaaaaatgcaactgctattagtggtattaaacaaaatttattggaggtcattgatttggactgacctcctgctctaggcttaacagaacaaaccaaaatggtgtcacttatgctaaagtttgatgtcaccaaactgaaactaagttgtttatctgaccttccaagaaaacaggagagagagaaagataatagccaaatccccagataggccagttttagccagcatgataagaagtcccctctgctttaacctttacaaagaaagttaactgaagttacctgatgctaactggttgctttttgttctgattctgctttcttcagcccttttctgcctgtaaagccaacctcctctgctcagctcattggagcactttttctcagtttttagagaaaaatgctacccagcttcataagtcacaaataaaagccaattacatcatttaactaaatttgtcataattttgtgttttgacagaggggtaataatcatccagccctcagacccccgacacggtgtcttcacctcctgccagtgtttcaggcttcctgaggtgcagcccagctgggacgtggaaattcccgaccctacacaccaccgcccgcggggaaggaaacatggacctgcaccaaagtgtctttactgtgtgccatctgattgcaaacagaactgggctttccaagagaaactgaggacagtggagagcttttatcttgaacccgggaggtggaggttgtagtgagccgagatcgcgccactgcactccagcctggcgacagagcgagactctgtctcaaaaaaaaaaaaaagagcgagagaatggccacagaggcccgggcattagggcttactggaccagggatgctgcagggggcttgggcttgcggttagagaggggccaggttttgctctccccaaagcaggggtccaagtctccccaaagcaggggtccaagtctccccaagtggggccacagaaagcagggggctccaggttaaattagagcctccaggccaccccacaccccgctctctaccccccagcactttcacccttaggttttcttcctccagggcacacagaagagcagatttctggcaactgtcagaaatctgaccccccaggggtccagcccaggagagcgagttacaagaagggcagaggtcggggaaagcgtgtcaggggccagtgctctccatgtgcagtgcgaggtcactgtcctgtggtccctgaaatcttctgggagcccaggcagccaggatagaagagctgtagaggaagggggaggaggaaagagagagaacaaagggaaaaaaaagtgaagaaagagaggaggcggggaaggtaggaagaggaccctaacttcctggagaggacctgggaacattgagaaaccagcccaggattgctggccaggaggatgctggtgtgtctctggggagcaggctcctttcccatctcatgcaactcaagagtctgagccccagtgatgggcttgcccctctcctccaagcagctctctagattcagtatcctggacccatttgggggtttttcttcctttgaagcactttgaagcagctgagtgaggccccctggctggacctcctaagtcagctgtatgcgtttcgcatagctactcacccgcctgcagcccagcctgcacccgatcagttgagagggatctggtccacagaggctgaggccaatagaggacagtgccccttctgcacctgcctctggctgtgagctgcaggatgtggtcaggagaggaagcgaggcctaggcccaagtcattctggggtttccagagagcttctcacccagggcattgacagggcactgtctgggtctaggcacgcctccctctcctcatccggcccctggagcaagggtcgggggaaagggagagtggggaagttcagcctcctccccctcttcctctgcctggccagagagcctgaggattgtgaaattggaccaggatagctccctccgggcagggagaggactcagtgagtccctctactgcgtatgggggaggatggtgcttcagggtgcgagcagctgcccagctaccatgcagcttttagaagctcagctaaggacatccaactttgcttccctttctcctgcctagcaagaactcaaaggttttccccacttcccttccacttcccagaaaaccccatctgatggagaatgcttgccccttcagccaaagtgggaaggagagagagctgatgggggcttagcgacctcttccaaatcgcacctccttccttcccctacatgggctgagcagtcagtttccaatgaggactctggtttctgcttccatggtgcctgcttctgaggcccttgacctcttccctctgcctttcacccactctctcccctctgccacaacaggagtctaggcgccatcgccctcgcctgcattcctgcctgcctatgctttctccccactccaaccactcacatgccactcatcttctaaaggtcagtttgcccagttcatctcctgggtcaacgtttttcagcagtgtgatggttaattttacgtgtcaacttggctaggcccagtgcccagatatttggttaaacattttttcagatgtttctagacggtgttttgttgttttgtgtgtgtgtgtgtgtgtgtttttagatgagattaacattgaaattaatagactttgagtaaagcagattaccctccaatctgtggaagtcctggttggaacaaagtctgatctccctggagcaagaatgaatcctgccagcaggttgcttcgaacttgaactccagctcttccctggatctccagcctgagagtctatcctgcagattctggatatgccagctttcacaatccaatgagccagttccttaaaatcaatcaatctctctcttgcattctctctctctagatatagctatctatacatacacatcttactggttctgtttctcagagagtgctgattaattcaagtagcttctcttcaacttcagtataaaaatcttaaatcctcacctagcccacaaggctcttagtcatcttacctcatataatgcctttgtacaaattagaaaaagccaccctctctaggcagatacagctctgaccaaacatagggcgaggtgggtggagaatggtgaaccttccctcttagtatagtgcacaacctggacaaccacatggagttgccttacttttgtttgtttgtttgttgtgtgtgtgtgtttttaattgagacagagtctcgctctgtcacccaggctggagtgcaatggagtgatcttggctcactgcaacctctgctgcatgggttcaagtgattctcatgcctcagcctcctgagtaactgggactacaggctcccagcaccatgctcgctaattttttttgtattttaagtagagatggggttttgccatgttgcccaggccattcttgaactcccgacctcaggcgatccgtccgtattggcctccgaaagtgctgggattacaagcgtgagccaccgcgcctggccgttcgttgtgggttttttgttgttgttgttgttttgagacaaggtcttgccctgtctcccaggccggagtgtagtctcgggatattggctcactgcaacctccgcctccctgctcaagtgatcttcccacctcagcctcccaagtagctgggactacaggtgcgtgccaccactcctggccaatttctttattttttggtagagacaggttttcacaatgttgcccaggctgatctccaactcctgacctcagtcgatcctctggcctgggcctcccaaagtgctgggattataggcgtgagcctctgcgtctggctgccctgcttctggatgagccactgactgacgaattagcctcgtctctcttccatgttctttccctttactccttcctcatcccaaaccctaacctccctgcagctcctggaacctgctgtgctcccttgctgctgtgcttttgtacacctgtcactgctgtttcaagtccctctcttattttctggtattgcttcctctggccaagttttgccgaggctcagcctgggtcagccttccctcttcttgcccggggtcctagcccttacttcaggtactgtgctgcttcatcactcgtctagattggagaatcctccagtgaatggggcttgagctttgatccatcgtgctgggcactagtaggtgctcaataaatgtttattgaacaactgaaaaccgggaagtgaatgaatggatgaacggggacacagcagctcgcagcgggcagcaggaggcgctcgccgggagggtgctccttcccttcagccagccggagttcagccagcgggcccggcgggaggagtgggagtgggccggggccagggccggggagaggggccatccccgcgcgacccgcagcgccgcacagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcgggtacgtcgtcactcccgcgtgcggccccgtcccgactcttggatcggactcttcagtcccttcttgcgtcttcccctctttcctctgggccttggtatgccccaggggacagatgtcttgggatctttaacatttgggatgctgcaaatgccgaagttaaatgaaatacctccggggagggcaggccgcagggaggctcggggggagggaagatggcctggacaaacaggtcctgaagctgcgaggctggagtggagggcgcaggggcaggcgggcggcgccagagctccatgggacaggtaagcgggaaaacttcggggcacccagtgcgggtgaactggggcgggggatcgggcccctgaacccacggtcttcagccttagcggagggtgccctacagggaatggggtaattttttcaaaggggcaggaattctgagttcctaccaaaaatgcacatttccagtccctcaacctttctccttcgaccttcttcgtgcctgtggatcttcctggccaggttccgggaagccagaaagcagccaaacaaaaggagcaaagtctcgggccagcctggatgtggagggcgcagtgggggaggggagcagggtggacaggacaaaggggctttttagagaaagcctagaggtctcatttcagggcgcattccaagctggcttggagttcccctgtcccagcccacttcacctttgcttagtggaggcgaacacctttcctagtgagcagggagcagacgcgagtaagaaaacagtgaaggaaccatctcctacccctcttgcctggagggtcccgggctatttcacttcttccttttttcactgttgtctctagcgctggccattgattccttaattcttgaagtaagattttagcagtgcctgagactactttgctgggggctgttggggatgtgaagatggtaggacgaggcccttgctttaaagaacttccaatctggtgttatcagaagaccctaaaagaaggaacttttttttaaaaaaaatggagagtggatggctacagcgctggggaagagttttctgactcgggacttttcctcaggaaacgaaaacactgaagaggtccagtttctcttccctggggaagggctcttgtctgcaaagatcagattccaagtactataatgttttgcaaggaaataccacttcctcaccaactggtggtctggacggcactctggggtttggggctggggcatcagtcccctgactccccggcctgactggagtggggagctgtttcagattcccagctggcctctggagtgcccacctcccccattggtattttgaattgaatgacatggccatcagagagctccaaggatggctccccggggttcttggcaggaggtttggttagccagctcccttccaaacctcagattctgcaaggttgggaaatattgagcgtgaatttgggggagcaaggtgtttttgagaattccaaaggatcaatgcaaacagtgagattgagcatctgtactaacctcccctgaagtcagagatggaggattacctgagggcagggattcttaactgggttcattggcattaggcatctgtagatggaattcagaggatgtgtaaactaggtgaggcaaaaaaagatatcattgtttttcaccaacctttaacagattttaacatcacctttagttatgaagacaacaaatcacagtagcattggcagtacctgtgactttgccattaatagaattcatagtttcatatcacactgcagtcacagcagtcttgaaatgttgtttacactcagcccttgtgtgaaattacccactgctagaccctgcttaatgttaataaagaagcatatatattgctatgtttttatatttttagaactttatttcatataattgacttttttagtgatcttcttaattttattttatgctcaagaaatgtgaactgtgagccaattcacagctggtagaaacttccaccaacccccacctggagctggagatgggcaaggtggaggaagggccgcttatgcccagagtcaacccctctctgtttgactttgtaagaaagtgccaagcctctatggggagggacggtgtgtcacggaggactggggaagggcagggctgcaggctctttgggagacccagagaacaagctcccaatggggcggggggaggaagaactgtcccctcttagggcccctcagcctcagcctgggcagaaaatgaggtggtcagcctggagcactctggggctagcattgtttggaaaaagggtgtgtacaggaatgtgaaggtgtgctgggtgtgtgtaccggagcagtgggggatgctgggggactccagccccatgagttccgctccacaggagatgcctggtgaaagcaaacttcctctgtcatccctgcacttgggggtagggagtggggacaggactttttaggggctgggggaggggaagcaatccagacatgtattgaggcactggaatctgggtcgggggaatggtgggaagatcagagagtggggggaaagggaggtggtaagatgaagacttgaggggtgcagcctgctggggacaggccaggcaacagtcagcgttagctctgcttccgccttgaaataggctagattccagtttcccatttgcttgggggtcggtgggatgggagatcttgaggcttattttttataggaaataagttccattttggtctctggctccttgcatttggggagtggacttagggtctggggtcacagtggacctcctgtggagtaggaaacaggacttgggctcaggtcagtgcctgtcagtgccccatgaacatgcgttgctgggggatggatgtaaataatcaacagagaagtgatggcctcgatacccttgggggacaatgtctgggataaaaagaacagcctgatcctctctctctaggattctagaacttctgcatattggaattccagctgccttgcctgaggttttaaaatcctcactcgggagagataaaacccaggccttggtcttcatttccatatgtggggaagagcagtgacccatccctgtcagtttgtaaatgtcctgcttgttttttccatggacagtggacatttcaccttgcttccggggtgcttaacaggcctcaatttctggaaagagaaactgaggtcaaaggaaggcagggagagccagggtcaggacaggagggcacgcaggtacctcacagctcagaatgttgtactagggtctcttgaggccatgaagacatgactcttgttgttgtcttctttggggattcctccatgggagcccctttttccctgctaccctcctgccccccggaagtgcagaggcccaggagctgcctgctggcaccagttgcacgggattagttcagggaaggacttgctcacctgctcctcccctctgactcaagtcataacaagtaacctggttcccctggcccggcagcctgggagggacggcaaggtaggcaggtgagccgagacggacggacggccagcagctccgtcagctggagagagagcacaggcctgtggcttgggagaccctgaggcgacatgtgagggccctgagccccctgactggaagcaggggctgtttttcaactcctggactaaagcccagaagcaggtgagggcgggggaggtggaatgggtctttggggctgagagcaggctggcctgggagtggaggagcccaagcagtggccatcacccccctccgacccccacccccgccagcctatgtctggtgtgtagggatgacagaggggtgctggtgggcttggacgggagcctgttcttgtggttgcctaggccttagtttccaccagagggagagcaagcagagatgagctgggacaggcaggcctgagacctggctttgggggacacacttgggatagaggaggatcccccatggcccggcctgagggaaggtgctctggagtttccctccctccctctgtgccccttctggtctcctctgcctttttctggggacattgttcagccgggtgggctgctttttagggcccagtactggagcttgaagaggcccaggagggatccctgtgttagggagggggtggggatgttacctgaactgcctttatctaaaagcaatgccttagacacttaagactcatagcctcctgggtgggggtggtgccctcgctctcacctgttgactctggggcaggttccctacagctgtggagggcggcctcggcagaggcagatgtgagggtccgctatgtggctgtacgggtttccttcttggcctgacattgaccaagaggtcgagattcagaccggggacctggaaaggctttagacactgtgcagtctttattgtgcacaggaggaaaggaagccccgggaggcctggtgacttccccaaggtagtacagaccgcagcagaaccaagccttgagcccacagccaggggctctgggcatctgacgctgttctctttgctctacttggggcagcaagtcatcccagagaggacccagcatcaggctgggaccactgggaagatcagtgcctcccctttgatgctggcagtcagagactgggctgagctgggagaaggggaagctggcggagacgggaggcgtgctaaggtacccctctgtccctgtaagtccccactcctctgcaacagtctcagagcccctgagaagcaggggctgagttggcccaactttccaaggcaactacttagtggttaataattaattagcaagcgtgactaattaatggcttcccctcccacattacttcctcctctgtgcaaagcagacacactcagcatgctagctgagaccaccttgcttcctacctctggctgcaccctgctcttggcttctggggagggtgggaggatggctagggtgggtgggaaggggtgggggtgagctgcctgctcctctgtcctgttcttatctctacgagggatagagtttgggacagatggacagtgcagagctaatagtcatcctaagtatcctgcggggtggggttccagaatatatggccaatctttcagaactttggcatgtttgcaaaggcctcccataaagttaaaaaaaataattctcccatgcattctctagacttccttgaataattgaaattccaaagtgcaaggtacatgttgctttcagggctttgtgtttgattgttgctgcctgtggttgctgtgttgtttatgtaggtctataaaagttcttgatcgtcctgctcttatcatcttgatgggtggagaggtatcaccagggacctggctgacagcagtcccctctccctgttggccttgctttgttaccagctttcccaaggccgacttttctgtcgtgttggctgcctgaggaggggtggagctcacctcccccaccctgcggccccgcgctctgaggaggcaggataggctccagacagaaactcggaaggacttttggactcttgctcaatgggctgactcagtgaggaggtggctgagctctctttccagacccaaccacctgcatgggctccgcccacccctcccacccctgctgcagccagcagctgccaggccctggccagctgggaccccaaccaggggtgtgggttggtgaggagggagagggggtgggcacaggtgttatctgggtgactggtccctagctgagccgacacaatgggatggcacctgtaccacccaagtgttctccaccccgaagcaggcagaggagcaggtgatctcctttctgtccttgcacagcttctgctctagtcactgcttgcccctctcctgtcaactcttggcaaccctgatagacacagccctgggtctcccctggctgtggggtgtaggggatctaggctgattccccttcagtggtctcccaggagtaattgatggcttgaaagttgtttgagggctttgggacagctctctggcatacagtggctgcacatatctgcagatgatgtgaagttcagagtccagggcgccaattcagagagtgggcgtcctggacttcggaggccccagaccagggccttggccatgtgcctgcccacttcttgaagtgtcctcagccactggggcgtaggacatgcctcacacctcctgggttcttgggttgaggatagctgtgtcccataaagatgtcttccccttcctcctttcttttttttttggagacggggtctctctgttgtccaggctggagtgcaatggcgtgaacatggctcactgcagccttgacttctccaggctcaggcaatcctcctgcctcagcctcctgagtagctgggactacaggtgcacaccactatgcccagctaagtttcattttggagagatggggtctaagttgtccaggctggtcttgaactcctgggctcaagctatccttctgccttggtctccagaaatgctgggattacaggcgtgagccaccatgctgggcttccttcctcctttctttgttatcccatcccattttttgtccccttcctttttatcctgtctctgctcttttccttcttgcccttctccccagtcgagcggttcttgtggctaccacagctgtcgacccccttaggcctagaggactttggcccagaggggagttaggctgggcccctgagagcccactgagaacagggtttgctggtgaggcccacagccccttctctaggtcagcacccccagtgccagaatctcctgccccagatggttcctgaagcacagtcctcccttccactcccctgctctcaagcatctattcagctttttgtaaccaagatggttcatatctagcttttttgttattgttctcttttctctttaaagctggggaagctccaggctacctacacaacctggcccaggctggtcacggtgtcccccctccctgctctgtgccctctccttccagaaatccaccatggagagtaaggatgaggtcagcgacaccgacagtggcatcatcctgcagtctggtgagtgttcagggaaatccccctgccctagtccctagtccctggtccctggtccctggccctgactcctgagtcctgagccctcaggcactagggctggctgggctgagactcccaagggctgagaggaaggggagggagaggcctctgctgggaggagggggaggttctggaagggctggagcctcagggacatgtggagttttcctccctggagaaaactggcttggagttttggttctatctggaagagggatctgcaatgttcaactttagccccagctgagaagttgaaaaatctcaggcaggcacagtggctcatgcctgtaatcccagcactttgggaggccaaggtgggcggatcacaaggtcaggagatcgagaccatcctggctaccacatagtcccagctatgtgggaggctgaggcagaagaatcgtttgaacctgggaggcggaggttgcagtgagccgagatcgcggcattgcactccagcctgggcgacagggcaagactccgtctcaaaaaaaatatatcatctggccaatgtgaaggtcttgcctctctgtttggccagacctgtgggcctagtctggcctagtcttgacagaggacaagaaagaagaggcttatgtgtgtgtgcaagagagaggggtagtggggagagggagagagagagacaggaagaagaaggagaaggaaaagaggaagaagaagggaggaggagtggggggaggactgcaccggcagaactccctcccctgcactcccccaccataggtcacctggtgggacgaccctcccttctgagttgtaacatttgtgcagccaagagacgtggtgttttgtggctgtgacacaggccacagcagccagcctgcaatttgtgggcaggcatgagatgtgtgtgtgtgtgtgcatgtgtgtgcatgtgcattcccctaggggtggtcaataagtaacggaggaggcttccatcttcagcctccctgagcatgtgccccccaacccttgcaggccccgacagcccggtctccccaatgaaggagctgacccatgcagtgcacaagcagcagagggccctggaagcgaggctggaggcctgcctggaggagctgaggagactctgccttcgggaagcggtgaggccccagccagcacacacaagcatcgggttcatctcaggagctgtggagccacgtgtggggatgcgggagctggggagagggagccccattcttgagggaattctggacatcaggctgggggctggggcccagagtccccatgatgcagtgtttgaccttgtgctggatggagaagagtcagacccaggcaggggcccaggcacagagaacaaagttcatcaggggctgcagagggactgcacagacataagtgcatatgagtgctgtaacccgggtcggtgtagctctggaggaagtgatcagaaagaggtctgaagggaaaggggaggagtgcagagtgggtctgaagacaggagagacagtgtggaggatgggatgaggtggggtggagggtggtcccaccagggcttctatggaaggcaggcacatgcagtgcaggggccagtgagccaagtctgggcaggtggagaggacctggctggtctctgcttcctccccaggagctgacgggcaccttgccagcggagtatcccctcaaaccaggggaaaaggcccccaaggttcgccgcaggatcggagcggcttacaaactggatgactgggccttgcacagagaggtgaggaacctcaggaagctgccagtacccctcgatccccaaagctgatcactgagacgccacacctcagctcagtaccctggcaggttcccttccaccctttcacacccagtgagggtgcttggctgcctgttggtgagagacaccatgaatatgtagcccaaatggctgtggagaaggggcgccactaaggaaccgagagctgggagctcaagggaggacactgggtttgaccccattgggcagaagatcagttaagagcaccagccaccaacccagcgggcaatagcctgctcagacaggttactctggcccctagggctgtcctcctttctcaggaggaggtgggggcagtcaggccctgggtgcccttcccctgtggcgtcaatggcagcagtttcccatgggccagcctgccccaccctttggggtcaggagggaaagtgtcccacttgggttcccaccctgcccggttcagcaggtgggctggtgggtgggtgcccatgccagcttttcaggctgacaagtttgcttttcggctcctcccactccttcaccctctgctccacgtccgtccattggtgctgctgtctgcctctcttctgtcctcagggcttaggactgggacctagagcactgtgtcagggctgctgtccaccctctgggcccccaatctccctgcctctctctagcctcactcctgccccctctctcaggaccccctaagcagcctggagcgccagctggccctgcagctgcagatcacagaggcagcccgtcggctgtgcctggaggagaacctcagcaggcaggctcggcggcagcggaagcactccatgctgcaggaggagaagaagctgcaggagctccagcgctgcctggtcgagcggcggcgcaatagcgagccacctccggctgctgctctccccctgggccgaggtgagccggctgccctgaggggggccatgctccttaaatgagcttttgagggatggtgggcgcacagccccgtgccactgcctttgcatttggctccagctgggtaaagctgattcttgggttcagctccaccccatcctgattctctccaactccagcaaggcttccccatcctgtgaggtcttcttctccgtctccttagaaaacaccctactctctccttccgtatcctcctcaaaatacactaccttcaagagacttcctacacagagatatttctcagctgaccctgagctgaatccaaggtgtattcaactgggtagcccaggctggccccgctgccctccaggcccacagggtgatggcatctctgggtcagggtagtgtgaggctcccgtgagcccaaggctctgagttgatgtgtagtcccctggcctgagttaggcagcaaagggtttgacgattgctatgtgttactgatcactgaattgtttcaggggcccacagctacttaggagatgttcaggttgaaatccagcaggactggtgccacaccccacagccccttaagtatctacaaccaccctggtcaagggtgggatccttccatgtctgttctctgccctccttgtgtctgtagttcaatccctgagctccttggcccagagactagtggccgtgggggcacctagtgagttgttgatgcccaggtgctgccacatcacatcagtgtgtccaccacaggttagcttccaacaggtggttctgagcccttaggtgtgactgttttcctttgtcctgacccaaggccagcctgtcaggtcaggacttgcatctctccattccaaaccccaccgcagcaggcccatgactcagctctgccccccgtctctcacatgggacccagacctccctggctgcctcagagggaaccgggagggaatgaggccgtggccctgcaaaaaaaaatccagaattggattcagaggtctcggccttcattcacattctcaggctcccatccctgcatatcgtgttggctttttgccaagactactcctcagcctgggagcagtcatggggaagctggaaagcccttgctagtccctgtgccctgcagcctatgcctcaggcagggagttatctcagcacaggtctcagaagtccctgctcctatccatggcttttaatttagggtagaaagtgcatgaccagacaccacccaggtcacctcccgcagccaagagtaggtgataaaggaggaggtgcctccatgtgacagttaacccagtaaactcagaagacagtggggctgacccagggaaaatggccagacctctgtccggttccagtggttctggcttggccgcagaacaacactcccagtctctgaggctctaatggaagacaagttctacaaccttactccactctcaacagggatcccaggacttgacagcaaccttgaaaggtagctgctgaattggacatggaagcccctaagggccaacttgctctgtgcctgcagggagaggtcagggtggtgagatatgcccgttggttgcagcgcctcctgctccccggtccagcctcacactgctcagcagcctcccctgcccaccggggctgccattgctgggagcttctgcccatgatgggtggcaggggagtgtcaccctgatgctgccattgtgacccataatgcttcttgttgggagtcgggagcaggccaggactggcctggggctctgtggaaggcaggaggatgaggttctgaaaccttggagccctcagtacaggtgaagacagagctgtggagaggagacaactggtgtagttgctgactttcccacatcaggaatcaagatcccactggccaacttcaggccctgggatctaaagtcctgttgtgagagcacagaagggatcagttctagacaagtaatttctgttttgtggctcctctgcccagccgagccctcctagaaaggaggaagtaaagcagaattattagtagctgaggtgttttgaattaaaaagggaaggccggacactgtggctcatgcctgtaatcccaatacttttggaagccaaggtgggcggatcatgaggttaggagttcaagaccagcctggccaacatagtgaaaccccatctctactaaaaatacaaaaattagccagacatggtggtgcatgtctgtagtcccagctactcgggaggctgagccaggagaatcccttgaacctgggaggtggagcccaggatcaagggagccgagatcgtgccactgcactccagcctggcaacagagtgagactttgtctcaaaaacaaaaaacaaaacaaaacaaaaaaacaggaggccaggtgcagtggctcacacctgtaatcccagcactttgggaggccgaggcgggtggatcacttgaggtcgggagttcaagaccagtctgaccaacatggagaaaccccatctctactaaaaatacaaaattagccaggcatggtggcgcatgcctgtaatcccagctactcgggaggctaaggcaggataatcacttgaacccaggaggcggaggttgcggtgagccgagattgcaccattgcactccagcctggtgacaagagcgaaactctgtctcaaaaaaaaaaaaaaaaaaaagggaaaaaagcaaacaacccaaaaaccgaaataaaaaaccaccctgcccccttgggctccatacaagggtaatttagtttgggaaagtaactgctaggtgagagtcatcagccatactttgcagtggcagggagcagtcaggtgttgagctcatttactagagtgaaccgcatgagggccacccagcacccacctgtgcaatgtaataggcactctggatgcatctgttgatcaacaacaccagccattagccacatcctcataacattttttttttttttttgagacggagtcttgctctctcatccaggctggagtgcagtggagccatctcagctcactgcaacctccacctaccgggtttaagcgattctcctgcctcagcctcctgagtagctgggactgcagatgcgtgctgccacgcccagctaatttttgtatttttagtagagatggggtttcaccaaattgtccaagctagtctcgaactcctgacctcaagggatcctcccgccttggcctcccaagtggtgggattacaggcgtgagccactgcgcctggccgctcatagcatttctgagatggtggaagtgttctgtatctgtgctgtccaatacagtagccactcgctgcatgtggctatggagcatttgaactgtgcctagtgtgactgaggaactgactttatttagttttaatgaaaatagccacatgcggctagtggcaactgtgttggacagcatagccttgggggaagctcagcatttgtgagtaaaatctccaccgttacccctctgtctggggtgtcctgcgatgctgctgcggggcaggggaacgctgagctagggcagggttgggacagttgctgagatagtgagcagctctcagaaacctgaatctttttttttttttttccaatctttttagagacagggtcttgttctgttgctcaggctggagtgcagtagtgtgatcatacctcactgcagccttgaactcctgggctcaagtgatcttccttcctcagcctctagtagctgggactacagtcatgtgccaccacacccagcaaattaaaacaaaacaaaacaaaaaaactattttagagatgggatcttgctatattgcccaggctggtctcaaactcctggtcttaagcaaacctcctgcctcagcctctggagtaactaagattataggtgtgcctggcccaatgaaaatctttattcctaaggtttttataaaagatcaaaggcaggagaccagaattcagtaagagggggtctctttaattgaaccctaaagcaaaggctacttgtgagccaagcaaagcatgggctggctggctactcaggagtcaagcccagctcctggtaccgtatgtcctagaaatctactgcctgctctgggtaaagattttttcattaaattgcggagcaggctgagcatgttggctcaagcttgtaatcccagcactttgggaggccaaggcaggaggatctcttgggcccaggagtatgagacctgcctggaccacacagggagaccctgtctctacaaataactaaaataaaaaaattggataggcatggttgtggacacctatagtcccagctactcaggagtctgaggtgggagattgattgagctcaggaggtcaaggctgcagtgagctgtgatcgggccactgcactccagcctaggcaacattgtaacaacccatctttaaaaagatgggttaaacctttgtggagcaaaggttaacaaacttttccataaagagccagacagtacatattttagtctttgtaggctctttggtctttatcacaactgttcaactctgctacttcagtgctaaaacagccagacattacataaacaaattcatagccgtgttccaataaacatttatttacaaaagcagctattgaactggatttgacccctgggccatagtttgctaacctctgttgtaagggatttcaagatggttggaactttttactttttttgaaacttcctgggcaatgcccatgcatttgagatgcaagctcacaggggagagcccataaagggttgtggttaagagcagactccagtcagactgtctgggtgtgaattctgactcaaccacctttgttgaatgtataacctaaaccacgttactcaactcctctgagacgtggtttcctcaactgtcacttgcaggtgataatatctaccttacgtggttgttatgagaattacctgaattaatatatataaagtgctgtatttagaaatgtattggcacagtagaaacattagcaattattactttttcctcatcttcattctcaaacacagttgaaaatgtttcgtgagttccatccaggtcactttaggcttattctcaagatctgaaggcctggccgggtgtggtggctcacgcctgtgatcccagcactttgggaagccgaggtgggtggatcacctgaggtcaggagttcaagaccagcctggccaacctggcaaaaccccgtctctactaaaaatacaaaaattagccaggcatagtggtgtgtgcctgtaatcccagctactcgggaggctgaggcaggagaatcgcttgaacctgggaggtggaggttgcagtgagtcgagatcacaccactgctctccagcctgggtaagagaatgagactccatctcaaaaaaaaaaaaaaaaaaaatctgaaggcttaagtttcttcaaaagcaatagcacaaatgagttccctctgatttcttaggtaaaaagtgctgctataccatgaagtaaagtcacactgaatttccttcaggtgacttgccagatcaccaactgaagaaacttccctggggccagctggccagaccttatcttaaattcaaattcctaccttgcgttcctcttgttgttggtaacacaggaggtctcacattgggatctttgaattgtgtttgtgatgtgagatgattatacaaaagttagagtgaaattcccttttttttatttgagacagggtctcactctgttgcccaggctggagtgcggtggtgtgatcacggctcactgcagcctcgacctcccaggctcaagtgatcttcccatctcaggttcccaagtagctgggactacaggcatgcaccatcatgcctggctaattttcgtattttttgtagagaccagatttcaccatcttgcccaggtgggtcttgaactcctgggcttaagccatctgctgccttggcctcctaaaatgctgggattacaggcatgaaccaccgcgcctggccatgaaattctttttatcctaagggccttccaaaatgaccctttgtctttcctttccactaccaagaagccctgccagaggacaccctttttctttttttttgacaggtggggaaactgaggtctagagcattgaaatggtttattcaaggttgcatagctagtatcagagtcaggattaaaatcaggtttcctgtctcctagctctgccttctatttttttctacttccatgtagtaagtttacagccaggccaggcacagtggctcatgcctataatcccagcactttgggaggccaaggtgggatgatcacttgagcctaggagttcaagatcagcctgggcaagacagcaagacctcttctctacaaaaaaaataaaataatttagctgggtgtgctggcatgcccctgtggtctcagctacttgtgaggctgaggtgggaggatcccttgagcctgggaggtcaaggctgcagtgagccatgatcacaccactgcactccagcctgggccacagggtaagaccctgtctcttaaaaaaaaaaaaaatcactcccaatgtgtatttagcacacagagggtatttcctcataactgatgctgtcctgggggagtgatcaggcctgagctgctcagcactgctggttactcatatctgtttgttcatttcttcacttccttctcttctctcccctttgtctttcgcagagctcagtgcctctgatgacagctccctgtcagatgggctcctcctggaggaaggtgagaaggacgtttgggggactattgtcaaggctggactcctactgcaagaccatggggtttgggcagtttgctggtgtggaatttaagtgggagtgaaggctagggtgccaggcttagggtttccgcttggacttcatgtcaatttccgcatgtccttgcacatgctcagttgaagatggggaatgtgcgatcatctcccattctggaagctcattatttttacagggaaaggaaaggtgaactccaagagagctgatcaaccccagatgtccctccttcacccttgggtgtgatttcaagatgcaccagtcagagccaaagagcaatctgcccacaatcattgctgttttttaaaagaagggagcaggaaggaaacacaagtctatagattaagaaccctgtgtacaaaccatgaggatgccagggtcaaggtggatcgagaagctgttgcagtcctgcccaggggagtgcccaagccaataaggaaataaataggccatatgggcatggcaggaacaagaaaaataggtaaacaaaagataactgcagacatggtaccaggaacaaaggttagaaagtggagcactgtaagcccaagagagtcaatctgggaggcttcttgaaggaggaaggcataaaatagggctgtgtgggaagaagtaagtcccaaaggagaagaaaacatgtttgagcatctagggctggagccatggcctgcagcagctgcacaagccagcatgggagggagagcggcgaggcatgggctgtggtttgtggaggttcttgttgggccggttcccccagcctctggccttaccaggtttcttttactcctgcagaggaatcccaagtgccaaaacctcctccagagtctccagccccaccttctcggcctctcccaccccaaacccttgagggtctgcagccaacaggacctgaggctgggagcccagaacgggctccagtccagaacagcccctggaaggaaaccagcctggaccacccctatgagaagcccaggaagtcttctgagccctggagcgagtccaggtcaggatcagggggaagggagaagggcagggcagggcagggagtcggtgggagctatgctggggatggctataggctgggcagatggaaaagtggaaaggtggaggagagagctcctgcagtcgtgggatggaggtgtgagccttgatagttccccaagggtgctggcagtttgccctactaactttgggagccccttccactgcatccccattcttctgcacctcttgagcccctgaatggaggcattcctgccactgacctgtctctaatccttttgcagcagcccagccaccacaccacaggatgggcccagtgcctccagcctgtggcttctggagcctgcctcctaccacgtggttcccatccgtggtgttcctggccagtggcagggccgcaccagtgccccagccacccctgagatacaggggaggaggggccagtcgcagtctctgaggtaagagacagcttccccagagagatgggggacccacttagagcttatcgttggagggtgggagctcccaggacacaggtgggacaaccctgggtgacacatggctagtgccttgacttctcttaggatctcttcttggggcgcctcttgacagagaatgcactgcaccccactaagccaaaggccatccatgaagcaagtggttttcttccaaagactctagttttgtctttttgcataacttgattcaaattttctacccttgccatgtttccttgtgctggtagattattattggtcactgacaataggcaactcactttttcaattgatgcacagttgattctcattatctgtggtagttatgttctataaagtaaaattgacgcaaatcctgaattagcaaatactgaacccttgcccctggggaaatatagggttaggttcccgtgagcctttggtcacgacattttgcatcaactgattaatatataaccttatgttatgtgagtttctgcttaaggacaccttacttaatatgggttgttgattcattaactcatggccaacagcactgtaactcatacccagatgaagcttacctagcacacatattttctccacaaggcacaccacagccttttcccagtatgccttagggaggaacagtagacagcactttggcactgtatttgggggcattttaaacagcagaatcactaatcaaagcaaaaacacacacagtacataaatatgccacaaaaaggacactgtgcacttacagcatgagaactgaaacatgagggcagaacatggcctcgtttaacctcagaacttaaagagactcaaatttgtcacttttctgcagtgtccaagaatgaccatgaaagcactgtgtatattgctttggggattaaaaataaagtttagcaactaggaaaattacaaatactgaatctgcaaataatgagaattgactgtatgttactttctaagtcatctgctacttggtaatagtttaaatggctaagcgttgacaggcagtattggccataccatatggggactggggcaccatgaaagcactgctgaattctccatcagcttaaattggctggtcaggcagcactgaactgggggcagcttgggacaactgctctcaagtaaagcaatggattttgtttaatttttaaattttttttgaggcagagtcttgctctgtcatccagcctagagtatagtggcgcaatctttgctcactgcaacctccgcctctcaggttcaagcgattctcctgcctcagcctcctgagtagctaggattacaggcgtccgccaccacacagcaatagattttatattttacatgctacgagggccattttacaaaccatgcctttgtgcaaattaggaaaaggcagacacagccccatacctgggtgcattagtagagtgaagtgaaggctggatttcagcccctgccggtcttgggctgcaggtaactgctctgggtaccacatgacagcttttacacgttcaagtaaggtacctggcagtgcctaccgaacagatgctgtggatgatctgccactggacacggtgtacctaagctgaaagtacttaatgtagtactttaaaaaaagtagttaatgtagtactttaaaaaaagtagttaatgtagtactttaaaaaaagtacttaatgtagtactttaaaaaagtacttaatgtagtactttaaaaaaagtacttaatgtagtactttaaaaaaagtacttaatgtgctacttgatgtagcacactttacacgaatcacaagcttgtgaatgcagcaggaacacttttgcacacagggaaggaatgcgttggcacccacgcagcccggcagagggtttgttggtttgctttgggagacttgacctaagacccttgcacgagggccatgcttgggccttgaggtagagcaggactcacctgttttaactccacctcccgccccaaccccagtgtggagtttctgccccccacactcagaatgcctctctttccctcttcagggtggattccttccgggcgggtcctgagggccgaggtcgcagcgcctttccccgccgccgccccactcactacacggtgacagtgccagattcctgctttcccgcgaccaagcccccgctgccccacgccgcctgccactcctgctcagaagacagtggctctgacgtctccagcatctcccaccccacttcgccgggcagcagcagccccgacatctcctttctgcagcctctctcccctcccaagacccatcgtcaccgcggggcctgggtcccagccggcagcagagagctggtcgcccaccaccccaagctactgctgccgcctggctatttcccggcggggcggtacgtggtggtggctgagagccccctgccgcctggcgagtgggagctgcgccgcgcagccccgggccctgcttacgaggaggagggcactcccctgcgctaccagcgtctggtgccctcccgcagccgcatcgtgcggacgccctccctgaaggacagcccggcaggccgggggctcagcaaggccgccgtgtccgaggagctcaagtggtggcacgagcgtgcacgcctccggagcacccgcccccactcactggaccgccaaggagctttccgggtcaggagcctgccccttgggagagagggcttcggacgagccctgggaccccgggcacaggtacggctgctctggagggaccccggggccaggcaggagggctgttttgttggggaggggctgcaattctagtatgtccaagggtacagaggcatcaaagcagcaacctagtggccgggtaatccccgtctaggaagaacaggccaaaaaatcatttcctcttggctttggaaggcactcttggcttccctggggcacctcctaattttgcctgccatgtctagctcaagagcatatacactggtggagatgatccccgaagatagctgagactttttctctccctaaatgatgatgcacaaagcagataagcctcttcataatcaaaagtccagtccaaatcagcccctcagatttccatttgaaggtctaggacaaagggagagtaggaaatgagttgcagaagccagaacctgtgattttctgggcatcagcatcctccctgacacccctcctcaccaccaagccgagaagaagggtggcatcagagttaagagcacccaccctcaagctagaccaccaggttcaaatcccagttctgccacttacgagctgtatgattgggcaagttacttaacccctttggacctagtgtttcctcccctgtgaaatgagagtagtagagtacctatctcatagggctgccaagaggctgaaatgattagagcaatgcatggtaagcgctagatatgtgatattattatcatctggggccacagaggccagggagcaggctggagggtagtatataggatagagcaccctgacactgggtagggtggcagccttggtttccttggcccctatttcttcattctggaagtggggagccacacacaggaatcctttctttattctttctccctggtacggagggctctgcaggtgatgtgctccagaagttaccaacaagctgcttctttgagaccccagattcccagcagacccagctgcgtgtccctcccccacccacggttctttggactgcagctggcatcctgggcctggcagcaccctggccccggtccgaggccgcgccctccagctgacgtgcttttccctttctgcgcgcttgggcctgtccttggctggatagacccagcccatcccaacgtgccagacagggagggtgatgagaagtgagcccaggaaaggtgggggaggaggaggtcagggcgcctgtcacaccccaaaagaacatggaggaaaatgtgtaaagggggtccctgaagaacagagagcatcctgggaggaaggggctgagtgccagggcctgctgctgctgctgcttctgctggtcagtgtccctaagggataaggatggtgtaactgtgcctgctgtccccgcttttctgcctggttcatttacccacctgtcctttcttcctgaccctggcaggtgcccacagtttgtgtgctgcggagatcgcctgatggggcccctgtgcaagtctttgtacctgaaaaaggagagatcatcagccaggtgtaactctgcgccccacgctggaaaaaactgtttcatagaggggctgggctgagacccccccacccctgagtgcctctttcagctcccccatccccatcgcaggccgatgacctggagctgagaccttttattattttttttttacacgacttttttcagaagccctgacctaaggatttatatatgtggattgtcctcaatacccctgtgatatgattatgttttatcccccagagtttggcctactggacttaaggccttgcctgtctgactgacagcctctatctccttatataagacaagtggcaggggacgagtgaagcagagtgagccaccttgggagttctccaacgctctgtgctctggttctaagaaattccctggggaactgcccctggccctcctgtcccactattgctggaggctggacatggtacatactcatgcacatgactctcccccatttcccaggtctctgggtaccccagcctgggctgggggagaatctcttcccccttttctaatgtgctctgtgatgcacacaccaagtggtaggtcaaaggtcagtatatcccggtggtgtattgtcttgctagaccctgctattttcctgaccccctaaatcctctttagggacccagtcactataccctgtctatgccctgtgggctcccagacccctgagctttgagtcagtggcatcacagtttgtagcctcagggggtctggctgggggctggtccatgcttgtggttagtggacagcagccaccctttgacagctacctctgggcatctcaagggcttgcagccccactgctccttctaacattttgtttgtttttgagatggagtctcgctctgtcgcccaggctggaatgctgtagcaagatttcggctcactgcaacccccgtctcccgggttcaagcgaatctcctgcctcagccttccgagtagctgggattacaggcaagcaccaccatgcctgctaattttttatttttagtagagatggggtttcatcatgttggccaggctggtctcgaactcctgacctcaagtgatccacctgccttggcctttcaaagtgctgggattacaggcatgagccaccgcacctggcccttctaacgttttttcatcatagtcccaaaaaccaatactttacaagtggttttggaaaggcaccacttttgtggcatgttctggttgggagagggagtcacagttcctactccccccaccagctatgcttctgctctgagaaggtggttatttatacaaacatggacatactcactcccaagggctgatgagatgctgaattttctttgggggcattcattaattgtcccagctgcagcgactggagcaagtctggaagctgcctgtgctaagaccacccagctgtccctgggttctcatcctagggccttctttgcttccaggtcaggggacctgcttcaatgagaaagcaactgaattgaggctaggagaggtagggagagctgagttctgacttcacctgtgcagaactctctgcccccatgttacctggactggaacagactgtgaatatagcagaaggttccaagaactctggtgtctgacctagaagaggcacagttctctctactggaaagaaaacgatgtagccgattgcacaagggtgccaagggaagacccaggatggcccatcaaaggaacctgggggaggatgcaggaggctgaagggatgcacctggcatttctctcactgtgctcttaccgcatcagcaacccccaacttttgggcctactctgccccccatgcgtgaataccctgcttggatgctgtgcttttccggtttgtctctaagcccctttctccagggcatgttggtttccctggcctctcagtgtcctaactggagcccagagtgccttgttctgagccaggagacggctgagcactggccctccacacctaagcgtcctttacattaacttattggtcttgtataacacctggtgccattgccaagtggctgtgtcctcagctacagagctggaattgtgtggggtttagtgctaaatacttcaataaagtctgttttttgtgattggctgagctggggatgagggattttttatttttatttatttttattttttggtgtgtgtgtgtgtgtgtgtgtgtgtgtgtgtgcgcgcgcgcgcgcgccaggtttccccgagcagaggctgagcccggccccctgggctgcccgccaaggtggccaagttgcccggcccctccagctggtctggccaggtccctggggagctggtgtgatgggttgggtggtagagggaggctctcagattctctgcttccggggcagggtggaagccagcacaacccctgtcaaggctccttacagcctcttcagcttgaggagctggcctgtgggagtcacttccccaaggacagggcactggccaggcagagggtagagatgggtggctcagcgcctccaagccattcctggagctttgactgcccggagcccaggctcatgagaaacagccccttccccatacctggaagactgggacccctccttggggtggtgaggaggcggggctctccgcaggcccctcccccatcggcaagagtgcccacagcccctccgctgcctggggtcccactgaggccaggggcggggagcgccaccttggacacttccgtgcttgccctgcagggaccgctccagggccccggagcacagcgccccctggagaggctgtgcccggacctgaggcgccggcgtgtcaggtaaaggggtcccccttcccgccagttccctccacagccaaggaaggggcggggaagggccccggccctcgctgcccaaggggcgcctccagccttgcctgggtgcggccctgggggccgcggggatctgtgggcctcaggggtctggggcactccattcttggggaaggtaggggaggggagacggctccagggtctctggagaagttgtggggtatcctgatctcagacctgagcgcttcgacctattatttgtggggaatggggcgctggattctgtattttagacgatggtgagttaggcccggggaaaacagggtgagcaagttcccaggggatgacctgtccaaggggcagctcccaacaacaggacagagaccagctaagaggggggatacaaaagagacggacacaggggcagagcaaggccctttaaggcagtgagcgatgggacgcgcccgtttggggacccgaagtgcagggcggtgagagaaccaggttgcacagcagtttcttcctggtccaccagcaggcttccctgggccatgtctgggaggggcagacatgtgggggctcttagctcccctaccatagggcagaagtaaggttatgaattagggggtggggacagaagcctctgggaagaggggacctcgggattttagcagcaagactcccagaggcaatttggcctggaggcagagggatggccactgtgacctaggagcccacctgtgagtctgagattctctatgctggaagatcccagaatggaagactactaggcaaatcaggagggaccagggcccttcagagggtcccgaatcttcccatggggaagaaatgggaagctgaccctggaacccggcactggccctactcaaccaattccttttgtggtaaatgggcagggtctgcctcctgcagcttccccctggagtgagtgcagaggctgtatccctaggaaggagtatcttacaccaggcctgcccactgttctcatcgcaagctgcaggctgctgccccaagtgtacagatgaatccgagttctaacaagcgaaaaccaaacagagtaacctttgaaccatcgacattacaaatctcttggaagtccagcttaccgggtgagcagttggttctgtctctcaattaactgtgggtgctcagaagtggtggtgattgcacaagccctcgcttgaggtgtacctaatgggcacacatctgcccacttctggctacccctgtcacagctctagtctctgcatgcctgtgctttttcaggcctgcctccctgagaagcctggagctgagccaggaacaagacattgcctgagactttcagtgacacctcctctagctgacagctgttcaggagagccagaacgctctctctctctctctctctctctctctctctctctctctatatatatatatatatatatatatatatataatttttttttcttttgagacatggtcgcattctgtcacccaggctagaacgcagtggcaccatcatacctctctgcagaggtatgacctgggctcaagcagtcctcccacctcagcctcccaagtagctgggagtacaggtgcgtgccaccatgtccagctaatttttggttatttgtagagatgaggtctcactatgttgcccaggctgttctcgaactcctgggcttaagtgattctcctactttggcctaccaaagtgctaggattacaggcatgagccactgcacccaggcagagaaatctttagataacatctacatgccaacaattcccaaattggtatctgcagtccagatctgcagttctggaattccaggctcttacatccgactgcctattgatatctccactttgatgcctagtagacatctcaaaattaatatattccaaactgaactcttaactttattcccaactgcaaatttgttctgttccccacatcagttaatgggaactcaatctttccagtgtctcaaggccaaaattcttgacttctctctctcatactcacatctagccatcaactattcctattggttctaccctcaacatggatacagaatctgatcatttgcatctaaccacctcccttggtgtgaaccaccgtctcacctctgtattattgtcataacctcccagttggtctcttgcttctgcccacaccccatgccattctccacctctactcctgatctattctcagctgaacagccagagtgctgttgttaatcaaagtcagaccacttttattcaaaacctgcccagggctcctgtccccagagccaattgtctttacaataagctacgagtccctcatgatctgccccattactgctttaccttcacctcccaccactcttccctgctcctcccattccagacacccaggcttccttgctgttccttgagctttccaggcacgatcctgcctctgggccttcacacttgctgttgccttggcttagaatgctttcttaccagatatataaatggcttgccattcacgttcttcaagcccacttaaattcaatgagattttctttgacctctgtgtatatacaaacccaaatgggcaaatacaaaataaaaattcttttagaagggtagttcctatgaaggaactccctggtgtgtaagaagctctgtgacagcaaagattattgtctcttttgttccctgatgtgtctaggagagtccttttacatagtaggtgctcaataaatgtatgctaaagaatgcactcattgatttcctactatatgccaggaagcattctaattttttttcacatattaatttatttaaatccacaacaataatagatactgtgatgatcatccccaggttaagatgtcagaactgaagcttgggggattttagtttgctcaaggtcacttcttacatgtattaagactcattgttcatttaatcctcaaataataacagatagtatcatcttccctgtcatacagatggggaaggtaaagttgacagagtttaatttgctggagatcacagagctgatgaagcagaggagctgaacttggaactcatgcagtttggtgccagggtcattgtgtgcagctcccgtgctttgggtccaagtcctattctgagaggcttttcttgcagggcagtgtgagagggcagcagcaacttgaactcaggcctgtgtcccatgctgctttggagcccagtggtgtcaccagctccttcctcttgctttaccttctcccgacttcacttggggcaaacaggctgtattcctggcctcaaccctcaggctcagagaggcatgccctgaaggctgtgccagtctagttggcaaagaagcctcccaggctgacttggggtttcaagtccattcgcaatcaaaactttcaaagtcagtctaggacagccctagaaatttgtggccactgggagtgacttaaaggtctcctcccaattgtttttccatcccgggccattgggccatacctgatgcagaaagtcttttttttcttttctttctttctttcttttttttttggagatggagtctcactctgttgcccaggctggagtgcagtagtgcgatcttggctcactgcaacctctgcttcctgggttcaagcgattctcctgttctcctgcctcagcctcctgagtagctaggactacaggtgcatgccaccacactcggctaattttttatttttagtagagatggggtttaaccatgttggccaggctggtctcgaactcctgaccttgggtgatccacccacctcggcctcccaaagtgctgggattacaggcatgagccactgcacccggctgaaaatctcttatctaatccccacatgatggcctttccactttggcttccattggcctagagaagctggttctggggaccctggtagcttctgggccttcttggtgggcaggaagggagggggaggatgactctggcttcctgttccatctggtggaatcagctaaactcccccaactacatcccttttcaggattgcgccaatcagaaagagaagcctatgagttcatagtggactttctagaagaagaacatatggtaagaaagttctctggacctttgtgtgaactgaggcggaaagtagaaaaaaataagagggcttatgcctccttgggttttgagtaccagccctggcttggaagccaccagatactcagcccattgttgcctcgtgactgggcagatctttggtggctaggccactggacagggtgtctagggcttagatcttgcagttcccttcctgtaggaaggatctttgtcagagatccttagccccactgtcctccagagccctacacaggtggccagacattggtgagcagcagtcctggggacagggacattgcactgagaaaatcaagtgagcaatccatcctttggcctagttgatgggaatctgggctgggtgtgaggagcaggggtggggtgtaggtctcaggtgctgcctgtgggcagagcctaagggctgaagcccagcttatgggcagcaatctgtgtattgtgtcctagtctgagttcaccaagctgaagttcctgagagctgtggaaaccttgagtagtgctgtgcatggccaagcagacggcaatatggacgattactatcccaaagccatcctggccaagaaaattgaggtgagaaagacccaagctcttctgggagttggtcattcagggatgaggatgacaagtcccggacctgagggctggcatctctctctgaggggggttcttgttttttttgttgttgttgtttgtttgtttcctggcctttctagatactaattcttgaagaatccactgagattttgatgggcaacatgcgtcagcaagccatgctctgcatcgtggcgctgaggtgcctttcctgctcttaccccctcagagcgcctgggtctcttgtgctcagaacatttgggttgggaggaagggcaaggtttggggacttaaattttggcctgtgggtggcatagcccccgtgtctgccactttatctgcctgcatccttgggtggagggggtgttctccaattgtacttttggaagcctattaagacgtccagtgagggaagcttccctagcaacccaggccctccttccctggaggagaggctattagaaagtgtttgggggctcagatccccactgtttcctgcatctcagaaacagcagcagagcacattctcccagagggtcccagtctctcccagggaccccaaagccgcttgtcattccctgcctctccctgcagtcaggtgaatccaccattccacttgtcccagaaactggatctggtaaatgtgggcgtctccagcctgttctctctgccgcctatcgtgcccagcctgtaccgaagagacaatgcgagtctctacctccaggtaatccccacctcttcatggagagctccacggggaggttttgtctttggagtcacctcttgccctttaactctccctcctttctcctgctctgacctctctgcagagctcttggccccatgttcctggggctgctaagaagcactccagctgtcgtaccctcacctgtctttccagggattggcccatgctcccaccctatccatgtccttgttcactaaggctcacagcagcctcagtcacgggaggagacagtctgataataaaacccacagatactgtggagcaactgaccagtagactgccaaatcttcccaggggcctctaattttttatttcatttttaatttttaaattttgagacggggtctcactctgttgcccaggctggagtatagtggtgcaatcatagctcactgcagcctcaacctccggggctcaagctatcttcccacctcagcctttgtagttttaaaaatagatgtgtcctggacctagcggaatgaatctaatgcggagagtcccacgggatctggctttcttggggagaatggcccaatgcctacatttcaccaatgggctcacaatttgggctggacctggtccagtcttcattgagaccaagaaaagtcagcaccaaggaagatcagagtgtggctggccatgagagagagactgccgggggtggcagagccaggctggccccacttccttcctccagaggtaggggacaaggagatggagtgcccccagggagccgagctggcactgtggcagtctgttctggacactccctgtctcttcacttgtcagagggtccaggccttagacaacatgttgcaggctcttgtgatggacaggatgaaccctaacatgctcatactacaaaacttcctggaggtaagtggctgtggaaatcaaggaaactgaaagtccatattaattctagtatgtttgggaggaaaggaaaagaatatcaggatagcctaggtgtcattctagtccaaagaccatcggttctcaagcctcagcatgcataaacatcacttgaagacaaatttctgtatctcccacgaaataccattttgaggatcacagttttggaaacatagcccactaagctgaggacccatttctgcccaggacttggacatattggggcttcgatggtaataacatttatatctgtgccagactttaatcttcaaagtattttccccttttgcagcatctgccattgctctgtgataaagaagacctcagtgcttaaccacaggctactcttatatcccttaatgtaatccccaccagagactcattgtacttctttaactgtctttagagcttcagagcgtttcaaatattcttagttatgacaaattgttatctcctgagggtagttgagttggggaaacagccaagaatcacttgaaaccgactttcatgaacacgatggtaatcaattacggtaataaaattttgcataaagcattaggtgtgactacaaagaaggagacaagattgcccaggcatcttataaaaagaccttgacaaggccaggtgcagtggctcacgcctgtaatcccagcactttgggaggccgaggcgggtggatcacttgaggtcaggtgtttgtgaccagcctggccaacatggtgaaaccccgtctctactaaaaatacaaaaaaattagctgggcgtggtggtgggcacctgtaatcccagctactcgggaggctgaggcaggagaatctcttgaacccaggaagaggaggttgcagtgagctgagatcaggccattgcactccagcctgggcaacaagagtgaaactccgtctcaaaaaaaaccccccaaaaacccaaaaagaccttgacaagggctttagctagagggaaatttgtccacatttggatgagtgacatagttcttttggaatgtatcatctctggtatgtttgttgagaaggatttttgtgctttttaggcaaccttgctataaatgtaagaacaaatgttctgttgttcttggagtctgtgggggaacagagatgcaaaactttggtcctggtcagggtacagtcttcaagagatccattactggggttctcattatccaaagataaatgatgccctgcaaaattaccacctgaaacaggttccaacattttgtataaaatagtggaggaatcaatttatcttgataaataaaattaaaagtataaaaataagttatttttatgcgaacaaaatgtatttttgctactttgaggtaattctcagtcaagtgtgtatatattttagacatatttttcctacaaaatgacatgatagcataatacaacatcatttatttcacatttgactttgcagagctggatcagaaaggtcgaatttgagggctatatggttttcttaagggccctcctttttcttttgtcttctttttttccgttttaaaattaaggtataatttacatatagtataattcagcttttagtgtgtagatctgtgggttttgacaaatgcatgcagtcctgtaactacagccacaattaagctatagaacagttctatcacccccccaattcccccatgactctatggtcaaccccttccccattccccatccctggcaatggctgatttgtttcctgtccctatagttttgccttttctaaaatgtcatctaggtgcagtggttcatgcctatagtcccagcacttcaggagggcgaggtagggggatcacctaagccaaggagtttgagaccagcctgggcaacatatgagaccccatctctactaaaaataaaagaaatatattagctgggcatgtggtgtgtgcctgttgtctcagctacttgggaggctgtggtgaggggatcgcctgaagcctagaggttgaggctgcagtgagctgtgatcatgctaccgcactccagactgggcaacaaagctagaccctgtctcgaaaataattaattcattaattaagataattaaaaatgttatctaaggctgagtactccagcctggggaacaaagtgagaccctatctcaaaactaaataaataaaataattaaaatgttatctaaggctgagtacagtggctcatgcctgtaattccagcactttgggaggatcacttgagcccaggagatcaagaccagcctgggcaacagtgagacccccatctctacaaataataaaaaaattatccaggcgtggtggtatgtacctgtggtcccagctacttgggaggctgaggtgggaagatcacctgagcccaggaggtcgaggctgcagtaagctgtgacagtgccactgcactccagcctgggcaatatacagggagaccttgtctcaaaaaaaaaaaaaaaaaaaaaaaaaaagacatctaagtagaattatccagtaggcagtctctggagtctgtcttctttcatttagcataatgcatttgagatttattcatgttgttatgtgtatcagtattttgtttctttttattttttaattgagtagatggatcacagtttgtgcattaattttccagttgaggaactttggggttgtttccagactgggatgattacaaatgaatcttctataaatctttgtgtgcaggcttttgtatgaacataggtttgtatttcacttgagtaaatttcttggagtgggactgctgtgttttatggcatgtggatgtttcactttataagatacttcccagcccagcgtggtggctcacgcctgtaatcccagcccttggggaggccgaggagggtggatcacctgaggttgggagtttgagaccagcctgaccaacatgaagaaaccccatctctactgaaaatacaaaattagccgggcgtggtggcacatgcctgtaatcccagctatttgggaggctgaggcaggagaatcgctggaacctaggaggcggagattgctgtgagccgagattgcgccattgcaccttagcctgggcaacaagagcaaaactccctctcaaaaaaaaaaaaggaggggggatacttccaaagtgttttcccaagtggccattttccacttccactagcaatgtgtaagagtcccagttgctctgcatccctgccagcatgtggtattgctagtgtttccttttagtcattcttatagatgtgtagtggtatctctttgtggttttaacttgcgtttcctagtgactaatgttgggcacgttttcatagtcttatttgccatctacatatctgctttgatgaagcgtctatttaaatcttttgcccatttttttattgggttgttttcttatttgggggtttgagggttattttattttattttattttattttattttattttattttattttattttattttatttgagatagaatctcactctgttgcccaggctggagagcagtgacaccatcactactcactgcagcctcgaacctccccgagagaccttcccacctcaggctcctgagtagctaggaccataggtgtgcgccaccatgctccactaatttttgaatgttatgggccaggcacagtggctcatgcctgcagtcccagcactttgagaggctgaggcgggtggatcacttgaggtcaggagttcaagatcagcctggccaatgtggcagaaccccatctctactaaaaatacaaaacttagccaggtgtggtggcatatgcctgtaatcccagctactgaggtggctgaggcaggataatctcttgaacctggggggagaaggttgcggtgagccaagatcatgccactgcactccagcctgggcgacagagcgagaatccgtctcaaaaaaaaaaaaaagaaaaagtttatgtagagctatggtctccctatgttgcccatactggtctcgagctccagggtgcaagcaatcctcctgccttggcctcccaaagtgctggtattacaagtgtgtgagccaccacgcccagccttgagagctctttgtatattctggatataaatattttgtcagatatgtgatttgcagacattttctcccattttgtggcctgattttatacagtgtcttttttttttttttttttttttttgagacggagtctcactctgtcgcccaggctggagtgcagtggcatgatctcagctcactaaacctctgcctccccggttcaagcaattctcctgcctcagcttcctgaataacagggattacaggcatgtgccaccacacccagctaattttcgtatttttagcagagacaggatttcaccatattggctgggcattcattgaatgcccacatcgtgttgaactcctaacctcaggtgacgcacccacctcagccgccgaaagtgttgggattacaggcgtgagccactgcacccagccctggccactcttaacagtatcttttgaagagcaggtagttattcattttgatgaagtccaagtcattatttttttttatggttataggaatttttgcctcccttaagtattttctcattttcttctagaatcttatcattctagattttaagtctgtggtcaattctgaattaacttgtgtattggacggtcaggtacacgttgtagttcatttttctttttttggcacatggatgtccatgatggggttcaatgctctgggagaaaggctaccctgaaggacacctgtccagcagctatgatacgggacacactttcccaaaagtttgtagcaagcaggacacaggcctgtcttccctggtgggatctcaacctagtgtggtaataataacacttacagggaagtgttgttatgggaggatagagtgcattattctattcagaatacttacctgtgtcactatgattattaacctccagaaatgaatggctctgaatctcatccttcagagaccactttaccccttcccctggcctagcaggtaggggtttgcatggatatgccaccaagagagccctgtctccccatcttatcccattcctgcttacccactgctttgtaattctacatctaaggcacagcactgtctttaaacattcctgtcagaagagacccagaaggtagcaggtgaagccccggagacttttttttttgagacagaatctcactctgttgcccaggctggagcgcagtagtgcgatctcagctcaccgcaacctccgcctcccaggttcaagccattctgctgcctcagtctcccgagtagctgggaccacaggcatgtaccaccacacccagctaattttttgtatagccccggagactcctaaacccacctttgctttgccaagttcatggggccgtgtgctctggtgcctggcacaactccctcctttttgtctttttagcagtcagagatgtggaattgagaaggaagggagcagcactcccacagaaggggttcacaaggtctctttactccttttccggatcatcataccttggtcattactgtcagacaaagtgtatgaacagatgcgggccttgggcactatttcctggctgctgaggtttatttgcaattttcccgaactgtcagtgagtgcttggagtggggggaaaggctgacccagtgggccctgcttctctgcacatggggtacctgagagtctgtggttctgcagggggttactggggggtgggtggtcagagtgtccctctttttttgcattagtgccttttctgttcctatgggggaagaggcttaacttgtttgcttggtttgcccttggccaagtgagtttcaattggctggacacatctcagccttgttgggggaccttggcctaaacagctgggttgggtccacagcttcccactggctaacatattttagggatctggctgccccatttccctgggtgctgctttgaaaggttttcttgggcagggaaagagtgtggagctggtgtggtgaggggatacctgcaggcaaatgatttagtggtgtagaggggtggggaggttggagagggatggtggccacagtatggggaatttccttttggggtgatggggagttaaccagtttcctcttctgggcagcacatggaggaattctcaatgagtgggaaactgatgagcatcttcggcctgttcgtcatgggctgcaaccacgagatcagcatagaggcatcagaggcgttgcattacctgttcaaaatccttgtgtttcagagaagtaagcaacatgagcctgagtggccactgggctacagccgtggggacccatgaataacaagagcatataagcaccattcactgaatgcccacattgtgtcaggcacacgatgaagggcagttccttctcatgagggcaatggagtaaatatgctatgatgccccaagatgagggatccccattacaagtagatctggaaactttatctggatgagctccaaccccattgctgatgcaatgccctcttgtaagagattctaagagattctcggggaaaaggggagctaggcttgcagccacctgtggaatcaacttggatactcaatatttctcagtggtctcagccttactgctaggcctaagactgggaaaatgaacatcttttcttagggaacaaatttgggagtgccagattgagaccctctttgctcaaggaaaacaaaaaatacaaagagtcacacacgcttacagaggtgccagaaggatttgcaaatatccctaaaaggagtttcagaaactctgacttctcatggttcaacagggcatacttcttataagggcatttgctcagcacccacgggtagaacagtccacattctggcacggcgcaggaacagctgcaaggaccagactgagtccccagccacattctccctccacccattggcctggtgctggggaactcttcccattctgttgagcaaatgttatttcacccatttcactctgttgatcttctctgaggtttggaggggaaataaagaagggtgtgttcctatttccctgttaaggccctgccccttaattgttgtttttggattgaaggtgtgaaacaaaagacagagactatcctgaaggatttgcagaagcatttccatggagcatggcttgccagcctccaggatctaacactggtaaccctcactctccacagtgcatgaaatgcccagatggggagccatgacagggaagaaagagagctggggtggggagattgtagagggcctgggtggggccacagaggagtactccttcacccaggggagtgtctccaaagctcaaggtctcatggacagcaggctggaggggtaagactcattccctagctgcacttgagttgactgaggcttgaggtcactgagagagttcttttttttttgaaatagagtctttctctgtcacccaggctggagtggcacgatctcagcttactgcaacctctgactcctgggttcaaatgattctgtagcctcagcctcccgagtagctgggattacaggtgcgtgccaccacgcccagctaatttttgtattttttagtagagatggggtttcaccatgttggccaggctggtctcagactcctgacttcaggtgatccacccgcgctggcctcccaaagtgctaggattacaggcatgagccactgcacctggccaagagagttctttaaaagacgtatagtcaaccctattctcctcctacagattgtgcccttgtaccttatttgtagcctagccttaatttttttaattcagtaaagatgtattggttgtcttagccgggtgtggtggctcatgcctgtaatcccagcattttgggaggccgaggcaggtggatcacgaggtcaggagatcgagaccatcctggctaacatggtgaaaccccatctccactaaaaatacaaaaaaaaaattagccgggcatggtggtgggcgcctgtagtcccagctacttgggaggctgaggcaggggaatggcgtgaacctgggagatggagcttgcagtgagccgagatcgagtcactgcactccagcctgggcgacagggcgagactccatctcaaaaaacacaaaaagatatattggttgtcttagatatggtgtctccaggctcaatcaactcaaatcactacagtcagaaatccaggagtcatcccttgctctttcctctccctcactcttcacatccaattcaacaccaggtttgttcattctgcctcctggatagctcttgaatttgtccactctgctccagccccactgtggggcccccagcatctcttgcctgggtcactccagcagccccttactgagcatcctgtttccaactgtgcttcttgtcacatcactttctatgctacagtcagagaactgcatttctaaaatgcaaatgctgagatgtattattccctttcagactgcattgaatccccactgtcctcattctaaagtccaaacttgttcacttgacccacaagacccttcatgatctggtccctgctgtaactgtcctgcctcatcttgtcttagtctcctttttccatctggcccaggtctcccttgcaggacacagtagttaggctgaacttccttccactccaggcctttgcatattctgttccctctgcctggaactctgtccttctttttccttgggtctgaatcatggcagtaggggaaccaaacacatccttcttcacatggcagtaggaaggagaagtgctgagcaaaggagaaaacatcccttataaaaccatcagatcttgtgagagctcactcactatcacaagaacagcatgagggtaaccaccttgacacatgaggattatgggaactacaattcaagatgagatttgggtgggaatacagccaaactgtatcactgacattgcactataactgcctgtttacttgccctgacttgatggtaaattccttgagggtaaaggcattgtatgtcttagtcacagttgtcctgagctcccagcaatagaaccaggcacagagctgggcctcaatattgtttgagtgaatgagcttcacgtggatatgcaggtgcaggctcagaggcatgaggcatgtctgctgtacataatagcactcctacttgctttggaatgctgcaagctcactaaacatcagaactaatttccaatggactcacttgcttgcattccacatggaagtagaaatgccttttgcattgtcttctgtatcaagttgtcaggaccattgctccttcctggagacttcagagctggtggcactctgaggcttggcttacaccacggaatagccagatgctgaccaggggctgcctccactggcccctggttgattagtctctttggaagccagaggctttggggcagacccaagttgggatgctgacattgtggagacagctgttcttctttcttcagttcttcaagaaatacctgaaccctgagaagagagcagatatgatcatggtgagcatggaggccatgaccaacaccagcaggcgtgacatctctgcagcttccaagatgttaaagatgatcctgaagtacacgattccagagatcgggaaggtagcagctctgggcaacctaatggttcaaggtcaatttaaggattcttcctttctgttctgttttgggtcttgttctatctcctaccagtttgagtttaaagaatcacatgcttcaacccagaggagaaaaggctaaatgaggagttgtgattgtggaaaagactcttctttgggaagggttgaccatctggcttccatctccaccaggatgggaagaagaattgagtcaaagctatagcagactactaggacctgctaggaccaggaaagaccacagtcattcttcctgcttccagacagtatttgatatgttagatctataggtgccttcttgtttattcaggagggataattcaggggtgtgtgtgtatataaatataaatataatatatatccataaacttgtgacacactaacataaatagagatgaaatacagagactcctttatgagacctgggactggttctcagtaaaattaagacagcgtagggctgggcgtagtggcttacacctgtaatcctagcactttgggaggctgaggtagggggatcacttgagcctaggagtttgaaaccagcctgggcaatatagcaagaccccatctcttaaaaacattaataaaaaaattaagacagcacagtttagctgtcctttttattatagtattttaaaatatctgatggactgatggagtccctcttcttttaatggcctaacccacttctctaactcacttatgacctctccactataggtcctatgagcagttccaggatcttacattttccacttctctggcctggattgccttttgattgaatgcctcagagcagaccactgataagttgaaggggaccccaaaggtcaactactctaactccccacttgatgcttgtaatctctttttaaggttttaaatctattttgtatggaatgcttcacgaatttacatgtcatccttgtgcaggggccatgctaatcttctctgtgttattccaattttagtatctgtgaagcgagcacaatgctcgtaatctcttcgagagcaccccagaccactggacacccagacggtgctgaaagcaatcttgaggccctcgctaccttaaaccatagctcatttgtatttgtaaatgactttcttttttaaaaaaaataatttttaatttaccaaaaggatatatatttatggcatacaacatgatattttgaaatatgtatacattgtggaatggctaaaccaagctaattaacatatcgattaactcacatactttttttttgtagtgagaacattgaaaatctactgtcttagcaaatttcaagtatagaatagtcaccatgttgtacaatagatctgaacttatttctcctgtttaaatggaattttgtatcctttgaccaatatctccccaatcctcctcacctccagcccctggtaaccaccattgtactctctgcttctatgagtttgacttttttagattccacatctaagtgagatcacccagtatttgtttttctatacctggcttgttttgtttttcaaaacaaaacaggttcatgtatactgttaaatgacagggtttccttcatttttaagggtgaatagcattccattgtgtatatgccacattttctttatccatttatctgttgttggaagcttaggttctttccctatcatggctattacaaaaaacgctgcaatgaacaggggagtgcagatatctcttccagacactggcttcattttctttggctatatacccttaagtggtattggtagttttacttttagttttttgaataacctccataatgttggaattttccataatggttgtgctaatttacattctaccaacagtgtataagggtgaaccactttccttatctaaaagttctaacttacagcacactgaagtctgcatccccatagtttctagtccctggcccaagtttaccttcttgggttatgcagaattcaattaatattcaagtgttactaatgctaggtgctatatactgtgctagtttcttttacatattcttgtattgaattcttacaacatatctgttgtaagaattattttctctttagaaacgagaaggccaggtgcagtggctcacacctgtaatcccagcactttgggaggcctaggaaggaggatcgcttgagtttgggagttcaagaccagcctgggcaatatagtgagacctcatttctactaaaaatcaaaagcattagttgcgcatggtggcacacacttgtagtcccaactactagggaggttgagatgagaggatagcttgaactcacgggatggaggctgcagggagctataattgcgccactgcaccccagctaggacaccagagctagaccctgtctcgaaagaaaaacaaaacgagaaaaggctcaaagacgccatgagccttaattactgaagtttcgccagcagttactaggtaacagacactgttccaaccaattcagatgcattaactcagaactgttgatgtgggtaaaatcgtcctcatattttgcgtgaggaaatagagcgcagaggatgaaaagctttcccaagctcacacagttggcaagtggggaggtgaaattcacatccaggtagtatgactttagagttcatgcggaccactacctgttgcctccaccccacatggccagtaaacagcaaggactgactcttctctccctccataatagtcttgagaccatttggaggcagcaatcgtatgccctccggcttcctctctctaagttactcatccttagattcttccttcattcttcatgacatggtttccagacatggttctggtctcccctggctgctctctattttgtccctcttaaaatatggggtctgttccgtggtgggcaggtctgtataaagctacccttaaaatccaaggaagctgagaggtcaaagaaagaggttgatgaatccagtttctgagaaagaaactactccggaggcagaggcaggagaattgcttgaacccaggaggcggaggttgcagtgagcccagattgcgccaccgcactccagcctgggaggcagaaggaaactccgtctcaaaaaaaaaaaagacccggcgtggtggctcacgcctgttatcccagcactttggggggctgagggaggtggatcacctgaggtcaggagtttgagatcagcctgaccaacatggcaaaaccacatctctactaaagatacaaaaattagccgggcgtggtggcatgtgcctgtagtcccagctacttgggaggctgaggaaggaggatcaaaccggggggtggaggttgcagtaagctgagattgcgccactgcattccagcctgggcgaccgagccagactccgtctgaaacaaaacaaaaaacaaaacagaagccatgtcccaggaggctgcgagatgagatggtggaccccccagccatcacccaccatggcccagggcttctatacaataggagtcggacatggtgggtgtgcctctagtcccagctactgggaggctgaggtgggagaatcactggagcccaggacatcaagtctgcagtgagctatgagcatgccactaccctgtctctaagaaactaacaaatataccttagagaaggaatgtgttgggcaattaaaatcaacccctcaggaaaaagcaagaatgctacgcaaatctgccctaagggcaggatttatggtaagggttgtttcgacctaaggactggatttacagcaacaatagataaagtaagtccgggcacggtggctcacgcctgtaatcccagcactttgggaggccgaggcgagtggatcaggaggtcaggagatcgagaccatcctggccaacatagtgaaaccctgtctctactaaaaatacaaaaattagctgggcgtggtggtgagtgcctatagtcccagcaattcgggagactgaagcaggagaatctcttgaactcagaaggtggaggttgcagtgagctgagatggtgctactgcactccagcctggcgatagagcaagactctgtctaaaaaaaaaaaaaaaaaaaaatagatcaagtagaaatcttagaggtattctgggaaccgagattaatcagaagtcaatatggtgaccaaaacgaaaagaaaaggaaaaaattaaacaaaaagaaaaaaaagaagtcaatattgtaggccaggcgctgtggctcatgcctgtgaccctagcactttgggaggccgaggtgggcagactgcctgagcccaggagttcaagaccagcgtgggcaacatggtaaaatcctgtctccaataaaaacacaaaaaaaatcagccgggagaggtgatgtgcacctgtaatcccagctactcgggaggctgaggcacgataaaacccaggaggtggaggttgcagtgagctgagatctcaccactgcactccagttgcatgggcgacacagcgagactctgtctcaaaaaaaaaaaaaaaacaaaaaaaagtcaatatggtggattagcatccaacatggggttgcttcaggccccatagggtccaaaacagtccacagtcctgagggtatggcctgaccagagcagagtgcagtgggacggtgacttttttggtctgggcatgctatgtatgcatcatgtgcagctctacaggtgaagtgggtgcctagttatgtggatgctggtgatctggtgttgaatgtctggaaagaacctccttttccctcatttcaggtgctggaaatcatccagtacattcactaccacatgaacagcattacagaaaccacagcccaaaagaccattaagaagatcctgtatctgctgtcccagtactacactgaagttatcctgacagtattgaagatagaagatcagtcacaaaagtaggtgactttcgatcccacaagtacatgcccccaatagtctgtttgcttcttcttaaaacatattcaggacctgagcaggggctcacttctgtaatcccagcactttgggaggcccaggtggacagatcacctgggagtcaggagttcgagactagcctggctgacatggtgaaaccccgcctctactaaaaatacaaaaaattagccaggcgtggtggcgggtgcctgtaatcccagctattcaggaggctgagtcaggagaattgcttgaacttgggaggcagaggttgcagtgagccgagatcacgccattgaactccagcctgggcaacaagaacgaaactccatctccaaaaaaaaaaggaaaaaagtagcggctgggcacggtgactcacgcctgtaatttcagcactttgggaggccgaggtcggtggatcatctggggtcaggagttcaagaccatcctggccaatatggtgaaaccccatctctactaaaaatacaaaaattagccaggcgtggtggcgggggcctgtaatcccagctactcaggaggctgaggcaggagaatcgcttgaacctgggaggcggaggttgcagtgagccgagatcgtgccactgcactcccgcctgggagatagagtgagatgctgtctaatatatatatatagatatagatagataggtagctgttctaacaagtgtgtggtagcctctcattgtggttttaatttgcatttccctaattcaattgcaactaatgatgatgggcatcgtttcatgtctttctttgccattcatatatcttctttagtcaagtatccaaatctttaacccatttcattgttgggtcgtttgttttcttattggtgagttttgagagttctttatatattctgtatacaagtcttttgtcagatatacaattttcatgtatatctcccattttgtggattgtcttttcattctcttaagagttcaaaagtttgtaatttgatgaaatccagtgttttgtttcttatggatcatatttagagtcataggtatttctttccatgatttcttctagaagttttaacttttgtgttttatatttatatttcacttttactttttagaaagcgtgaggaatgggactaggttcagtttgttgcatatagaagtctaattgttccagcaccatttgttgcagagattatcatttctccactgaattgtctttgcacatttatcaaaaatcaattgacggctgggcgtggtggctcacgcctgtaatcctagcacttttggaagccaaggtgggcagatcacttgaggtcaggagttcgagaccagtctggccaacatggcaaaaccccatctctactaaaaatacaaaaattagccggggatggttgcttgcacctgttatcccagctacttgggaggctaaggcatgagaatcacttgaactggggaggtggaggttgcagtgagccaagatcgcgccactgcactccagccagggtgacagagtgagaccctgcctaaaaaaaaaaaaaaaaaaaaaaaaaaaaaaaatcagttgacagtatttgtgtgcctctaattatgggctgtcttctgatccattaagctatatgtcagttctttcatcaataccgtactgtctctaatagtgtagttttattttaagtattaaatcaggtaggatgagttcttcaattttattacttttttttttttttttttttttgagatagagtctgactgtcacccaggctggagtgcagtggtgcaatcatagctcactgcagcgttgaacttttgggctgaagcaatcctcccacttccacttcctgagtagctggaaccacaggcacatgccacctcacccagcctttttttttttttttttttggtagaaacggggtctcaccatgttgcatggctggtctcaaaactcctgagctcaaatgattctcccgcctcagcccaagtgctgggattacagggtgtgagcagttgcacctggcctataactctttctcaaaattgttttgactattttattttgcttttccatataattttttttttttgagacagagtctcactctgtcacccaggctggagtgcaatggcatggtcttggctcactgcaaactgcatatcccaggttcaagtgattctctcacctcagcctcccaagtagctgggaatacaggtgtgtgagcagttgcacctggcctataactctttctcaaaattgttttgactattttattttgcttttccatataatttttttttttttgagacagagtctcactctgtcacccaggctggagtgcaatggcatggtcttggctcactgcaaactgcacatcccaggttcaagtgattctctcacctcagcctcccaagtagctgggactacaggtgtgtgccaccacacccggctaatttttgtgtttttagtgaagatggggtttcactatgttggccaggctggtctcaaactcctgatctcatgatttgcctgtgtcggcctcccaaagtgctgggattacaggcatgagccgccacgcctggcctgcttttccgtataaattttataatttaaatagaatatttatttatttaaaaatatgctggtgatatttttattgggattatgttgcatctatagataagtataaggagaattgacaacttcacaatattgagtttctggtccatgaacatagcgtatctcatttatttaggtctttaatttctttcatcagtcttttgtatttttcaacacacagatcttgtgaatattttgttagttttatacctaagtatttttgtgcaattgtaaatggtacataaatcttttttaaatttttaattgtttactactgctacatagaaataacatcaatttttgtatattgactttcattgactttatatcctgcaataagtgaggtttcacttattagttcttggagctttttaatagattcactggagttttctacataaaccatcatatcatctgtaaatagaagcagtttatagtgtttctttttcttccaaatttgtgtttctttttcttgctttattacactggctgggactcctagcataatgctgagtatgggtgatgacagtggacatctttgctttattcccaatcttagaggaaaaactttcagtctttcaccattaagtatggtgctagatggtagggttttgttgttgttgatgttagatgtcctttatcaagtttagaaagtttccttctatttctagtttgttgcgagtgtttaccactaatggagattatcacaaatgttttaactacatctattgagataattgtgtggtttttcttttgtattctgttaatataataaattgcatttttgactgtggaggcagtcttgcattcccaggataaaccccatttggttgtgatgtattatctttttaacatattgctggattcgatttgctaatattttgttgaggacttttgtgtctatttggttgaggatttttttcatgggagatatttggtctgtagttttttctttcattcatttattctttctcttttttcttgtactgtcttgggtttttgtgccaagataatgctgaactcaaaagattgttttgggagtattttctttttctttatcttttttttgtttttttttgagagacagtcttgctctgtcgcccaggcaggagtgcagtgggacgatcttggctcactgcaacctccacctcccaggttccagtgattctcctgccttagcctcctgagtagctgggactacaggcatgtgccaccacacccagctaatttttgtattttttagtagacaaggttttcaccatattggccaggctgtcatcaaactcctgacatcatgatctgtctacttcggcctcccaaagtgctgggattaatggagtgagccaccgtgtccagcctattttcttattttctattttttggaggaaattgtgtaaaattggtattactttttttctaaacatttagtggaattcaatactgaaaccatctggatctagagttgtatttgttggaagttttaaaactatggattgaatttatttattagttagggtcattcagattatctattaatttgctcatcttctagtcacttaaggtggaaatgtaaattactaatttgagaactttcttcttttttaaaataagcatttttatgctatgaatgttcccctaagcatagttttacctgcatctaacaaattttgatatattgtattttcattttcatttagttcaaaaattttttctaattttccttgagtctttttctctcacccatgaattacttagaagtattgttaatttccaaatatttgtggattgtccaggtatatttctgttactgatttctagtttaaatttattaaggccagataacatactttatgggattccttttctataaaatttgctcaggtttgttttgtagcccagaatgtggtatattatggggaatgctcatgtgcacctacaaagcatgtgtattctggccaggcgcagtggctcatggctgtaatcccagaactttgggaggtcaaggtggctgcatcacctgagtccaggagttcaagaccagcctggccaacatggtgaaaacctgtctctactaaatatacaaaaattaacgagggacggtggtgcgcgcctgtatacccagctactcaggaggttgaggcaggagaatcacttgaacctagggggtggaggttgcagtgagctgagatcctaccactgcactccagcctggtgacaaagtgagagcctgtctcaaaaaaaaaaaaaaaaaagaatgtgtattctgctgttgttgcctggagtgttctgtaagttaggttatagaacaacacagtgttgttcaggacttttataaccttgctgaatttctgtctacatattctgtcaattactgagagaggagtgttgaagtctcccaatatgcttatggatttatctatttgttccttcggttttatcattttttgcttcatgtatttcattaggtgtatatacatttaagattgctacatcttcttgatgaattgactgttctaccattaattaatgtccctctttgtccctggtaatactctttgttctgaagttccctttgtctgatgttagtatggccatttttgcttttcaaacagtttgtatttgtgtggtatatctttttccattcttttaactaatatgtataattatatttaaaatgtttttttaatatagcatatggttggacttgtgtttttatctaacctaacaatctctaccttttagtttgcgtatttaaatcatttataattaaagtaattaataatatgtttggatttaagtctaccattttatgatttattttgtttttcccctttgttttttattcctgtgttcccctttcctgcattctttcaaattgtttgaatttttttaagcattctattttaacttgtctattagattttgattctttgtaccaatttttagtggattcctgggcatttatatgcctaaagttttatagtctacttacatacctaaatttccatagtctgcttagagttagtatttcacaattttgagaaaatgtagaagctttcactatacagcttcttttaccttacttttttttgagacagagtcttgtaggctggagcacagtggcacgatctcggtcactgcaacttccgcctcctgggttcaagcgattctcctgcctcagcctcccaagtagctgggattacaggcgcacgtcaccatacccagctaatttttctatttttagtagagatggggtttcactatgttggccatgctggtcttgaactccttgaacctcaagtgatccgcccgcctcagcctcccaaagtgctgggattacaggtgtaagccaccttgcccggcctaatttttgctttcgatagtcatacatatttttaaacttaagaggagaagaacggtctgttacatttactcatatatttgccattcctgttgctttatcttcattgttaaaatttcaactttcactctgatacaatttcttttctgcttgaagaacttcattagcatttaatttagagcatgtctttgagtgataaattcttagttttcttccatatgagaatgtttcaattttaccttcttttttttttttttttgaggcagagtttcgctcttgtcaccagctcttggcacccaggctggagtgcaatggcgtgatctctgctcactccaacctctgcctcctgggttcaagtgattctcctgtctcagcctcctgagtagctgggattacaggagcccaccaccatacccagctaatttttttgtatttttagtagagacggggttttgccatgttggccaggctggtctcgaactctgggcctcaagtgatctgcctgccttggcctcccaaagtgctgggattacaggcgtgagccactgtgcccagccaataaatttctgtttattataaattacccagtctatgagattttgtgatagcagcacaatacaaactgagacaatggcaaaggggctttttcagctaagaatcttgagaaagggagattattgtgaattactcaagtgggctcttaatgtaatcacaatgtgtcttgtgattgatgtatcttgttcgaacttcactgcacttcttgaatctgtaaatgtatgtctctcaccaaatttgggaagttttaggtcattatttcttcagatatttttttctgtacaagtctctttttctttttataagatttcaatgacatgaatattcgactttttaatggtgtcctataagtccctgaagctctgttaatttttttctaatttcttagttcttcagattggtataatttttattgattcatctgcaagttcatgaacccttctctctgcaatctccattttcctcttgatctcatccagtgaatttttgtttcagatattgtgtttttcagttctaaaatttccatttggtttttttaaaaaatagcttattcctcagctaagaacatgagaaaatccgtctttccacttctttctttgtttctttgcttctctctctctctctctttctttagttcttttttgagacagagtctttctctgttgccccaggtagggtgcagtggcatgatcatagcttattgcagactcaacctccgaggttaaagctatcctcccatctcagcctcctgagtagctgggatcacagggatatggcaccatacccagctaattttttaaactttttgtagagacagggtctctctatgttgcccaggctagtcttgaactcctgggctcaagtgatctcccgcctcagcctcgcaaagtgctgggattacaagtgtgatccaccactccagacctttccatttatttcagttatgtacatctttacctcatgcagcatgattaaaatgtctacttaaagtataattattattatttttagacagggtcgtgctctgttactcgggctagagtgcagtgacgtgatcatagctcactgcaacctagaactcctgggctcaagtgatcctcctgcctcagccctcaagtagctaggactacaggcatgtgccaccatgcccgctattttttaaattcattttttagagaatggatctcactatgttgctcaggctggtcttgaactcctggcctcaaggggtccttctgccttggccttccaaagtgttgggattatgggtgtgagccagtgcacccggccatctctcagagttttagctgcctgtgctgctacagctgcacaactggatctggcttcagggtgatgaaatgagaaaaaagagagagagagaaaaaaatagcgcttcccccacccctacactcagtgggccacagtgccctgtgttaggtgcttttgttgctgccccaactgcttccactgtgcagctctgcatctggactcactctcgggacagagcttgggagaggaaagagacaaagaaagaaagaaacaaagattccacccatacttctccaactcacaaggacccattttcccagtcctctggccagagagacagagttttactaagagattttgttgcctgtgcctgctgcatagttcagcactcgggtcaccttcgggtcaaagctggaagataatagagaaaaaagaattctgggaaactcactcaaatgttgtttttccagtgttgggaggtagttgctttttgtatttgtccagtgtttttagttttaactggtgcgagagctgggctggagtggacttgctctgtcctagcagattgtgtagactctcttactagggaaattaggattgcttgttgttaatttcctttatcatgagaaggaagtgtctttctagtctatatctgctgagtattttttttccactcatgtggaattgtttaataaaaggttgatatcatataattagagtgttttcttttgggtcgggggtggtttgagacagagtctcgctcggtagcccaggctggagtgcagtggtgcaatcttggttcactgcaacctctgtctcccgggttcaagcgatttgcctgcctcccgaggagttgggattacaagcctgtaccaccatgcatggctaatttttgaattttcagtagagatgagatttcatcatgttggccaggccggtctcaaactcctgacctcaggtgatctgcctgccttggcctcccgaagtgctgggattacagggtgagccactgcacccggctggacaaagttataatctgataggaagaaaaagttctggcatagtagagtgactgtggtcaacagtaaggtatcatatattacaaaacagccagaggagaggcttttgaatgctttcaacacaaagaaatggtaaaatctgctgagtttttttgaaaaataaaaattaggctttgaaataccaaatgcccttacaacatctaatgacatatttatacaaatgtatacaggtttctttctttaaccttttaatttccaagtggttagatattttgatcatctttttctagttttattggatgataactggaaaacatgatctaaatgtcttctccttttgagaatgtgttgaggggttcttttgtgtgtatagaccaggaagattaatgttatcaattttactatatgtttaatggctatttgaaataaatttatattctctactgcatgcaaagtcatctattagaccaggcttgtttatttatttattttccttttttgtatatttttaaagtacagatgggtctcaccatgtcacccaggctggtcttgagctcctgggctcaagcaatcctccctcctcggcctcccaaagtgctgggattgcaggtgtgagccacctcactcagccagaccaagcttatttaattgttttataatatctcattgtacaataactacaaacttattttacccatttttttaatgactatttgttgtttccagcttcttgctattattaacagtgctgttatgctcattcttactctaatattgtgtttgatttataggcatatttaccattttatttgctcaccatcccttgcacctcaaactttccttaggaaattatttttcttttccctaaatgggaaagagaaaacaatacctctaaaggtattatttaggagtttatcctctagcgaggctctattgatcaaaccatctatttttgtttatctacaaataaagcaaatctgcattaaatgatagatttgctgggaacttgtgggttgatgtttatttttgttccacacttggaaggtttatcccactgtcttctgctctccactgtttctgtggagaagttggctgtcagtctcattgccattctttcactgacgactcattttttctctcttgtttttgtccccagagcatgcgtgtattgtttgccagctgtgaaagtctgtcttcaccttttatctcaccttcatttcctcaatgctttctcctcctgtttcaaaaaggccatgacttcttgaggacattaagcacattttcttaaaattttatgttatttgtagcaaatgcttttcagatatgtacttttcttctgagtgtgatttttccaggtaaaaatgagaggggagacatggtaggcaaagggaaaggcatgtgcccaatgatagaggagagagagcttgtgtatggggtgaggctgggggtgctgtgcggggctggtgatcagacctggcctgaagaggggtgtggtcatgctgggtattaaggatgacaggggaaagcctggaagacagatgcagtggtctgagggtgggtgggtagtgaaagcttggacaggccagagagaagggacccacagggaggctcttctcactgatctgacacattcaagtgtggtcaacaagctttggcctcagatattttctcaaaccaggttcatagaccaagtgaacatttccagatttgtgtgagatgacagagaacagggaggtctggaggtgatggcaagatgaaagaaatagaaggaaaaagagagaggggataatgaagagagagacaagaaaggaggaagaaaccaggggagctaggggcctgggcaaaggagcctagagtcgcctcccctggaagcactgtggagcctgtggagagtgggttacctggagtgggtaactgtgtccgtgggtttctgactctgcaggggggtttgcaaaccctgggaaatcctggcatccttccccaaaggctacgaaatgatcgtggactacctgcttcagaggctgactccacactggaggccaaaggaccaggagcccagccacagaacagagatctcaccattgattgtatggaaaggccagaagaggggggccggggtggggaaggggactccctgctgtcctgttctcggctgccttgggctctttggccttgaccttttaggtatcggtgtttggtagaacagtataatggcagtcttggagttgggttgcagggagggttttccagttaactttgctttgtcagggagatagaagaactggatttcccagctgctctttaactctcaaagatggtaagagactaaaacaaccaccatgattagaagagcgctttaaaacaatgacattctagaaattgccctttatttgtctggctcacactaacttagtcttcacttgctctagcagcacgggttttactgggcaagtctgtcatggtgatgggttgtggaaagagatttcctggtgacaggacctatgagtcgaagatacgataatgcttcactctcctcctccctccaaggccaccagggccatccatgagctcctgctggaacccagtcggcagatggaggtgcagtccttcttctcctccttgttcatggccctgctgttccagatctcctttttggtggttgaaggggacgctgaaacaagccgggatcagcaacacatagctgaatggatggaccccataaggtactttggtgtttgctagtgattatgctccagggaccatcagcttagcacctttgcctgacttggtgtcagcctactgagcctgaataccctctgtacaccctcctgccagggcatttaacatgttccccatgcatcatttcaagaagtgtccctgggcttaaaaaaattatattttattattttatttatttagagacagggtcttgctattttgcccaagctggtcttgaactcctggcctcaagccatcctcttctctcagcctgctgtgttgctgggattactggtgcgagtccagctgtctggactttttagaaaagactccttctttaaacctggcctactaggctgatgcagagattctgcaccaaaatgagatcaatactgtggataaaacacacatctggatccacagacctggattgcattcctacccttctgctggctcgctgtgtcaccttgcagatgccacatctctcttggcctcagttgcctcacttgtaaaatattagcctgggtctctggaggctgtcccaccaccagcagttcatgatcctgagaaagctttgggagtcgggcaggtggccagtgagggagaggagcgcagatggtgaatgacttcgtatctgttttcggccctttctccagttctaccatggaggccctgaagaccttgattcaaagttctggatatggggactgtgtgtcttctattcagagacatggggtctgggggctgcttgtcaatcctgaaagacactatggcggagtcactctgccggccaggtgagctgcacctgggtccatggctggagggctgtccattcacttggccctctcctgcggcccaggcctcacctgaacactgtgctcttgttgataggtccgttgtcatcaataactgttggcacaaccgccccctcttcagctccatcatcaggttcctccaggacccagacctgcaagaatcacttaacggcccttgtgttcctgacagaggtgactggctcttggcgggagggggcaggtgagggtgatccctctgtgagacagccacgtccaacagacacctcctgggaaggccactgattcactgctaggaagggttgggggacatggctaatggcacttgatttggttaccttgagccgggggctttggtgcctccttgaatctcatggcagtttgactctgccctgactttacagaagaacacagctctctccttcaaccacctcagccttgagcagccttttaaaattaatccttgcttagcgtccctgattgactcaatataattcagccacctgacagaaaaaaaataggaaatttagaaaatatggaaaagtatatcaaaaattataaagccatcactaagcataatccccagaggaaaccatattcattcaggtttttgcctgtatacaggtgtgtgtgtgtgcgtgtgtgctagttgaaatcattttctactaatattctgtatcctgctctattcaaatatctgtatatgtcattacatgttctttgtaacatacatttttaaattttgttttattttattttttgagacagggtctcactctcttggccaagctggagtgcagtggtgtgatcatggctcactgcagcctccatctcctgttctcaagtgattctcccacctcagccttctgagtagcgagatctacaggcatgtagcaccgcgcttggctaattaaaaaaaaattttttttttaatatggagaagtggtctcactatacttcccaggctggtcttgaactcctgggctcaagtgatcctctcatctcggcctcccaaagtgctgggattacagttgtgagccaccatgcctggcctataaacataaatgttaatggtgatataatgtttcatcacaaagatgatctgtaatttattcgacattctgtttccaattttacacaattataaataacagtttaatgaacatctctgcgaaagtttttgcccatattacagattatttccttaactattgaatataataagtggaactattggttcaaaaaatatgaatgtcttctataacttttaacaataatgccaaattgctttccagtagagctgtaccaatttagacttccaccaacagtgtttgggagaatttcagagtttctgacccactacagctttaaatgggatccttttaaaattcaagccacctgatttttttttttaacagaggctggactacttttgaacataaccacagagatagaagataatgcattactaatactaggatgtacactgatgttatcccagtgtgtcatcgtgtgcccttatgtggattacaggacactggtgtcttgttggaaggtgtccactgctagaggctgatctgtacatgttggtatggggtgctgagatacacattcaaggatatatgtcatgttggcagaacttttgctcagggtatgggaatgagacatgtaggattcagaaccctgactggaaggggatggctcagtccagtggatctcgataatttatgaacttcatatctcagggaagctgtttaaaatgcagattcctgggccctgtccccagagacttggattcaggaagtctggggtaaggccaagaagccttttttgctggtggtggtttttttttttttttgagatggagtctctctgtcacccaggctggagtgcagtggcatgatctcggctcactgcaacttttgcttcccaggttaagcaattctcctgcctcagactcctgagtagctgggactacaggcacgcaccattacgcccagctaatttttgtatttttagtagagagggggtttcactatgttggccaggctggtctcgaactcctggtctcaagggatccgcctgcctttgtgcccaccctccagaagtcttcattttctttttttctttttttttttttttgttgagacagagtcttgttctgttgcccaggctggagtacaatggcacgaacttggctcactgcagcctccatctcctgggttcatgtgactctcctgcctcagcctcccgagaagctgggactacaggcatgtgccaccaggcccgactaatttttgtacttttaatagagacagggtttcaccatgttggccaggctggtctcgaactcctgacctcaggtgatccgcctaccttggcctcccaaagtgctgggattacagacgtgagccaccacatccagacgaagtcttaattttctaaaagtactccagtggtggctgtgccacaggaaatgcttggacccagctttgggaaacagtacaaggcacaaacccgtgtggacaggaggccaccatgagatagctgccactctctttagagcagtaattgggaaccctggctgcgtatcagtatcctccctggaggtttcaaaaatgctaatgccaagcccccaccccgcccctcactctctgtcaaatttttctatttgaatcgatctgggatggggtctaggcatcagtttgttttagaagctcccaggtttaaagggatgctctaaaatacagctaggattgagaatcactctagaagttcccccaagtgtctgatacccagctgaaacaaggggacacacgatagagcgtttgctcatctgccactctgattggggtttcgggctgataacggggaggggaggtcagcatgcttgggaagaggctggaaggagcaccccagtagcgagatgggtgaaccccattcttagcaatcagagagagaagcagtagattctaaagtggaaagccaatggggttttaggtaccagctaagtaagtaagtcaagatctgttaagtgagagaccatggctaagaaagctttctaatatttcacagcctttgtcactccctgtttgttgcttcattatctttattcatttccttgagatgatcacaagtagaaacgtttaaaacagaaaaggtcgtatgcttttcttcagtgtactcaagaaacagcagagctctgttattttaattctctctaattctgtgaaaagggtgttatttacctctattttgtagagcacgaaagtgaggctcagagaatttaagaagttacttactcaactagagggtaaattagggtggtggatctgcctgactgccaatcaaagacagatgaaaactgctgagatgttaatgaagacttctttgccaaatgtacattcatatgtgcatgcatacatgcacactaaagcaagtacatatattttaaatgtatctgattgaattttgcctttttaaatgttattttattatttaaaagatattttctatatcacaagtcatcaagcaataaatgttatttaaaataatctatatacacatataatacgaataagtaaattaaaccatgcaaactgattatttttttattttattttattttttgagatggagttttgctcttgttgcccaagttggagtgtaatggcgcaacctcagctcactgcgacctccacctcccgggttcaagcaattctcctgccacagcctcctgagtagctgggattgcaggcgcctgccaccacacccagctaattttttgtatttttagtaaagacggggtttcactgttggccaggctggtctcaaactcctgacctcaggtgatccacccgcctcagcctcccaaagtgttgggattacaggtgtgagccactatgcccagcctatttatttattatttatttttgagaaggagtattgctctgttgcccaggctggagtgcagtggcatgatcttggctcactgcaacttccaccttccgggttcaagtgattctcctttctcagcctcctgagcagctgggattacagatgcctgccaccacgcctggctaatttttgtatttttagtagagacagggttttgccatgttgaccaggctggtctcaacttctgacctcaagtggtccacaaactgagttttgaagtgcagtctttttttttctcttctacttttgccttctcccctcctaccacattacgtctacacctccacctcttcatctcccaagtatctcagatgcaagcaaccaagtacgtacccttctgcatgctcaaataatcacacacacataatagatgttgacagattgttttccaaagaagcactaacaattcacatttatctcagggaagtgtgagagaacggtgtctctatctcttccaacaacaaagcttaactctttttagatgtttgtcctcctggcaggtataaagcaggggtgtccaatcttttggcttccctgggccatattggaagaagaattgtcttgggccacgcataaaatacactaacactaatggtaggtgatgagctaaaaaaaaaaaaaatcgcgaaaacctcataatgttttaagaaagtttacaaatttgtgttgggccacattcaaagctgtccagggctgcgtggggcctgtgggccgtgcgttggacagacttggtgtaaagcagtatctcattgctgctctggtttgcatatccctggcttctactgattttgaacattccgcatataattctgtgatttggattcgcctttctgtgaattccttcccatgtcctttgcccattgtcctattgaattgtttggctttttcttgtctacaagactaatttaacttctgattttccatttgcatgactacatgtgtttttccattgcaatgttttccatcacgtgcatgctagtctatttttaaacagagtgcatgccaggctggtttatccaggtgaatgtactgatatgtgtaagtctgagccagcctacctgtgcagactcaaggtgtccatctggcatgttcattccaaagcatgtgcacttagagcaggagttctcaaccctggatgcatattcatatctccaggagaacttacactaatacttgggtgccaactcagtacaattaactcagaatcttgggggtgacgtggggtccaagaatcagcatttttaatagctttgcaagtgacactaacatgcagccaaggctgactgcctaggagtcagcatcgcttttcgatatcacccagcagagcctggagtccccagtgctgttgaatgatcattacaaggatttctttctttttcttttttctttctttcttttgttttttgttttttgttgaggcagagtttcgctcttggtgcccaggctggagtgcaatgacacgatctcagctcactgcaacctccacctcctgggttcaagcgatcctcctgcctcagcctcctgagtagctgggattacaggcatgtgccaccacacccggctaattttgtatttttagtagagatggggtttctctatggtggtcaggctggtctcgaactcccgacctcaggtgatccgtctgcctcggcctcccaaagtgctaggattacaggcgtgagccactgcgcctggccgacaatgatttcttaataattctcctttttccccctccctttaaaaaagttactattctaggggactgtctttgacttttctcttttgctttttcagcacgtcagtaaatctgactaatacgtgctttgcagtgttcttcagggtcatcctttctccattcccactaccctggcctagtccagacccttattacctgtgcttgaagcaattattttaacttttttttagagacagggagtctcgctatgttgcccaggctggtccccaactcctggctttaagtgattgtcctgcctcaacctccagagtagttgggattacaggtgtgagccgccacagttgactagagcaactccaaaagataacatgctgatctctctcctcctaggaccttctgtcaacccaacacatttcccacgcccaacatttcttgccaatgggatcctcctctggagtcgggccagcacccagttgcccttccctcaactacattacgcttagcttatccctacatttcgcccttgttttgctatacccaccttttcccgttaaacacacacatgtttacgttcccctcccatctgctcattgaagttctctttattcaagttcagctcaagttttacctttctttttttttttttttaaattttttttggagacaaagtttcgctcttgtcccccaggttggagtacaatggcatgatcttggctcactgcaacctccgcctcccgggttcaagcgattctcctgcctcaacctcccgagtagttgggattacaggtgcctgccaccatgcccagctaatttttttatttttagtagagacgggctttcaccatattggccatgctggtctcgaactcctgacctcaggtgatccgcccacctcggcctcccaaagtgctgggattacaggcatgagccaccacacctggccaagttctacctctttcacaatcttttcctagatgaatcaacacctgtttataataattttttacttgcttttaatttgtgtagtattgttattgccttgaaatgttcactaggtcgttcatgtacctaagtcttgactctccagctgaattgctaggatctttgagggcagagtgcatttcttacttttatctcctgcagtttcccttatcaaaaatgcttaatgcggctggacgtggtggctcacacctgtaatcccagcactttgggaggttaggcgggtgaatcacctgaggtcaggagttcgagaccagcctggccaacatggtgacacccccctctctacaaaaaatacaaaattagccaggtatggtgacacatgcctgtggtcccagctgctcgggaggctgaggcaggagaatcgcttgaacccgggaggtggaggttgcagtgagccgagatcgtgccactgcactccagcctgggcgacagagtgagactccatctggaaaaaaaaaaaatgcttaaggggccaggtttgtggtggctcatgcctgtaatcccagcactttgggaggctaaggcgggtggatcacctgaggtcaggagttcaagatcagactggtcaacattctgaaaccccatctcaactaaaaaatacaaaaattaggtgggcatggtggcacatgcctgtagtcccagctactcaggaggctgaggcaagagaattgcttgaacccgggaggtggaggttgcagtgagccgagatcataccactgcactccggcctgggcgacagagcaagactccatctcaaaaaaagaaaatgcttaaggaaaacttggagaatgaataaatgacttctgggatgacaggtgcaaattcatccttaaagctttggcctctctaccaattctaaacccttaagaacatttccctactagtgagtaggaacctagtccaaagtcattgaggatttttttttctccttgcccacctgtctttcttggtctcccttccccagctgcttcagtgcccagatgtggcagccttagtggatgacttcaccacctgcattctggcaaactggttcaagagtgaggagccagccacagtgaagccattgctgcagatgctagaggtctttgcgaagcatgaaaacatggtaaaatggggcaggggctaagggtgtgcgctcaggagatgtaaccaggagaaggaacatctggtgtgtccagttatagatagggtgggacacactcttgggatcaaagagagcaaatcctcatgaggccagtacagcacagacaggagttggggcttgagccattcatgatttctccctcccaggaaaggtctcctgaggaagttttttcatgggtcatttcagagaatagaccaagctaaccccaggatctcacacgtcatccaggtcccttggagattgctgtcatcatcagggatgagaagcgcagtggcgatggaaacttacagtgtagtgggaggagggggcctcctctgttttctccccttccctcatgatggacacaaggtacctccccaaatgccctcctgggcagctcactccgatggccacccagatgctgggccagtcccagctctggaatgaaaaagcagtagagtgtggctctcaattgtggggctgaattgacttgaaatgagaattccttggcttggcaggagttatttccccagctccccattccctgagccactgtctcccgcaggtgaggcggctccgaatcctccagccctatgtgctgaactgctgctactcctcgaacagcgacatcgtactggagactttgctggtgctgaagaatctcctgagccacctcacctggcagcactcctcctccttcctgacccagctcaccttcacgctggtgcccttctttgaggaggtgaaggcctctctggggtcattttctttctttaggcatctgtaaaataagggagttggccgcgtgtggtggctcacacctgtaatcccagcacattgggaggccgaggcagtggatcacatgaggccaggagttcaagatcaacctgggcaacatagtgaggcctcattctaacaacaacaacaaaacaacaacaacaacaaattagctgagtccggtggtatgcgcttgtggccccagctatttgggaggctgaggcaggaggattgcttgagcccaggaggtcaaggctgcagtgagctgtgatcgtgccatgcactccagcctgggcgacagagcgagatcctgtctcaaacaaaacaaaaaacaaaacccctcacagagttggcagaatgattcaaggtcgttcaccttgaatacgatactgttctgtagggacttgattgctcctgccctccttgtatctttctgaaggggtgagatggagcaagagaacagagcacagcaggcgggggtcagagcaggtcatttgagggagcgaatggacacaggagtgtggggttggcgggggtggagctcagggacgtgatggcttctgcttccccacgcatgcgtgtcttctctcccaggtgtcagagcatctgcggttggcagcctttgagatctatgggagtctcttgaccaaggtcaagaagaggggccttgtcttccccttgaaacaccagatcctcaacttgctagtccccctggtgctccacctgagggacgtgaataccgatgtgtctctggtgagaggccaggccttggagcctggccttcagtccccgttttcatgggaggtaaatgctaaacatgttgagtgcttaggcagggctgtggcagtactggatggtgctgaaggagtcaactagtctctgaccttgcagagttttagtgagagactagagatgaacagacgcttgcactaaagtttttttttttatttttatactttaagttttggggtacatgtgcacaacatgcaggtttgttacatacgtatacatgtgccatgttggtgtgctgcacccattaactcgtcgtttaacattaggtatatctcctaatgctatccctcccccctcccccgaccccacaacaggccccggtgtgtgatgttccccttcctgtgtccatggcttgcactaaagttttctccagcttctggctccatctggttggccactgactcccagtggaatactgtgggtgtttctcctgggaggaaagtctcatcgacgggcagcagtccctctctctgcctccctgcctgtggctccagggggcccctctccatgctgctctctgcatactctctgcctgtgaatagagacagagttccctgggtcgggaagaccccgtgggaggcagtgtggtgggcagaatagagacggcctggaactggcctacatttcggaatgaatgagtccagctttgagcccaggagacccaggaacgtgaactgcagcttgaacacttgaagactggctgacttactctgtgacaggacaccttgtttccacagagcaggctactctgccgtcactgaggcctcttaggcgcatctgaggccggctgggcaagcgattgaatggggatattatctttgcgcgggggtgtcccaccggtgaactcagccgtggtattcctgacagagccagccctgatttagaacagtgaccacccagttgggggattaagacttcggggaaatttgttttcagagagactgttttgtggggcagggaggatgggggggcggcggcgtgggaagccatgtctctggtgaataaggctctgagctggatagttccagtgctccgggtcgcagtgtcacaccacaacaattgggaaaattgttagaactgtaatttttaaacttcttattagtgggaaaagggggttgtaagtagagccaagctgcctggacccctgcctttttcctaagccctggatccctgtcgattcaccagtgagatttccatcccatcgaggctgaatgtgatgccgcttgtctccgttttttgcacccctctgtgtccctgcccagtgccactccccagctcctcatgctgagcctccttgtctcccagatctgccggtctgccctctgccacactgctgccgtgctgggctggtcaaagctgaaagcagtatttgcagagaaagatgtgtggaacattcttggagccctggtaagccagcagcttgctcactgtctgcccctatgcgagggagggtggcatccccagcggtctaggtccttttcctgcagctctggggtttgcagcagtagtggcagcgggcagcagcaacagttcaacgatgagagactcattaagcacctactttatgctcagcacctagatatggttcctgccctccccttgtttcctgtctgaattggggagctaggcacacaagtagacaatcccagaatactttgggaaaggcaaaggaggggtacccagcacagtctgggagttgaaggaaggcttcctggaggaggtgtcatcttcagaaggagaaatagaaggcagggtaacacttaggcaaagggacggaatcaagagtgcaggccaaggtgatgctgtacacaggggtgtggagcaaagcactcactctgttccagggactttgcacacattatctggtatgatttgatcctcacaaccatcctgagaaataagggcagaagggcctggtgtgtggggagctattaatataagtgccttggaatcattagagcaggggcagaaaaggcaaatgcttacaaggccatgtgggaaacactaaccagaggtcagactgggtgggcccggaggagagatgtaggccccaaggcccagcacaggcagcctcctcagcatggccagaaaccacacaccgttgtcacagcacacatttagtgacaccaactttactctcctaaagtgaaattcgtaaataatatcctctacctttgcatatttccaaaataagtaatataatgccctaacgccaaaggagaagtgaaagtaatctacaacaaaataatctgtgtgaatatatggaacacaatacagcataacacaatataataatagaaaataaatactatatgtaaatgcttgggccaagttactttttatttatttatttatttatttgagacagagtctcactctgaagcccaggttggagtgcagtggtgcgatctcagatcactgcaacctctgcctcccgggttcaagcgattctcctgtctcaggctcccgagtagctgggattacaggtgcttgccaccaggcccggctaatttttgtatttttagtagagacggggtttctttttatttttgagacggagtttcatcatgttgaccaggctggtctcaaactcctgacctcaggtgacccgcccacctcagcctcccaaagggctgggattataggtatgagccactacgccctgccagggcccagttactttagaagaaaatgatgtgcatgaatccttgcccctctccatagaatcaatgtgaatggatctgctacaaatgcagaatgttataggagttggagactcataccacaagaagggtcaccgttggtgatgggacttccaaaatgattatattaatagctccccccacaccagggaagtctgattagaccagaaagtctgatgactttctgaacaagatgaagtatagtctttgatgtctattgcagatgcattcctagaaaatccagtatgtagttgaactgtgaaaaagttctctgttatctaaaaaagccaatttctaggcatggattattataagtaggtttttgagagacataaatgtgtaatgggatattagaaataggtgtacccccactcatcattttgaaaaccataaacatcccccagttccataattccctccacacagtacagtccccagttgagaacccaccaattgtttctaggaaagtggctcagggttgttaagagaagcaggaaatcgatgccaggtgcggtggctcacgtctgtgatcccagcacttggagaggccaaggtggctggatcacctgggaacaggagtttgaaacagcctggccaacatggggaaaccctgactctactaaaaatacaaaaattatccaggcgaggtggtggacgcctgtaatcccagttactcgggaggctgaggcgggagaatcgcttgaacccaggaggcggaggttgcagtgagctgagatcgcgccactgcactacagcctgggtgatagagcaagactctgtctcaaaaaaaaaaaaaaattaaaaaagaaagcaggaaatcctgattggggtgaaatttcccccattaatgttggcaaataatttaaaatgtaaaatgctgcgtagatcaaacaaaaaaaaatatcttcaggctggctttgctcatggactgtcagtgtgcagtccggtctgggcaggagacaccaagcaggaagcaggaggctgggccacactgtgctgtggaggtttgggcccagtgaggagcaggacttgaggctgtaggcaaggggagttgttgaagcgttttaagcaagtgggtagcatggttacagagctgtgcatttcacacaaatcacccaagctacagatcagagaaacattcccaagggacggaattggagcctgtgctggagagtgtctggggagaaatgatgaagtcaagaagacaaaggcatgggcgggattagctagttgtggagattgatttgatgtgaactgtggaagtaaaagttgcctcttggcttctgacatgggtgaatgctggtgtcctggactgaggtcagaaatacagagggaggaacaggtgtggaggggaaggtggtggcttgattttgggcatgttgagcttgtaaaatctgtgagaatgctagtacatctattccattggaagttagatatgtatcactgaagcttggagaacagggctgtgtttggtgaacgctgagcataccattgggtggtagatggagattgcaaccctaagcccagacatgctctcctaaggtaattgtgtggtgggaggagtatatgagtcaacactgagattccaggagacatcagttccaaggatcccacagaggagactagaaaaggaaaccaggcagaaagtcaaaggaggacaacaagagaggagagtcatggtcacctaggaaggaccatgaccagtttcaggaagcagtcaagggtacaaaaacccaagggtttctcgggtaacttcaaaagatgggagagatgagcaggcaggctaggctcagcctccccacctccttcaacccaagcagccccacttctccttctctttctccttctccttcttttttttgtagagacagggtcttgccatgttgcccaggctggtctccaactcctgagctcaagtgatcctcctgccttggctttccaaagtgctgggattacaggcgtgggccaccacacctgcccccccaccccttctgttagtttgggatattgggtttccagttaagatttctttttga
